US010550377B2

(12) United States Patent
Madec et al.

(10) Patent No.: US 10,550,377 B2
(45) **Date of Patent: *Feb. 4, 2020**

(54) SUPPRESSION OF PROSTATE CANCER USING A TARGETED CLOSTRIDIAL NEUROTOXIN

(71) Applicant: IPSEN BIOINNOVATION LIMITED, Abingdon, Oxon (GB)

(72) Inventors: Frederic Madec, Oxon (GB); Philip Lecane, Oxon (GB); Philip Marks, Oxon (GB); Keith Foster, Oxon (GB)

(73) Assignee: IPSEN BIOINNOVATION LIMITED, Abingdon, Oxfordshire (GB)

( * ) Notice: Subject to any disclaimer, the term of this patent is extended or adjusted under 35 U.S.C. 154(b) by 0 days.

This patent is subject to a terminal disclaimer.

(21) Appl. No.: 14/250,954

(22) Filed: Apr. 11, 2014

(65) Prior Publication Data

US 2014/0219983 A1 Aug. 7, 2014

Related U.S. Application Data

(63) Continuation of application No. 12/996,641, filed as application No. PCT/GB2009/050666 on Jun. 11, 2009, now Pat. No. 10,240,138.

(30) Foreign Application Priority Data

Jun. 12, 2008 (GB) .................................. 0810782.3
Nov. 17, 2008 (GB) .................................. 0820965.2

(51) Int. Cl.

| | |
|---|---|
| ***C07K 14/33*** | (2006.01) |
| ***C12N 9/50*** | (2006.01) |
| ***C12N 9/64*** | (2006.01) |
| ***C07K 7/08*** | (2006.01) |
| ***C07K 14/48*** | (2006.01) |
| ***C07K 14/575*** | (2006.01) |
| ***C07K 14/60*** | (2006.01) |
| ***C07K 14/65*** | (2006.01) |
| ***C07K 14/82*** | (2006.01) |
| *A61K 38/00* | (2006.01) |

(52) U.S. Cl.

CPC ................ *C12N 9/50* (2013.01); *C07K 7/086* (2013.01); *C07K 14/33* (2013.01); *C07K 14/48* (2013.01); *C07K 14/575* (2013.01); *C07K 14/5759* (2013.01); *C07K 14/57563* (2013.01); *C07K 14/60* (2013.01); *C07K 14/65* (2013.01); *C07K 14/82* (2013.01); *C12N 9/6489* (2013.01); *A61K 38/00* (2013.01); *C07K 2319/035* (2013.01); *C07K 2319/06* (2013.01); *C07K 2319/33* (2013.01); *C07K 2319/50* (2013.01)

(58) Field of Classification Search

CPC ............................ C07K 14/33; C07K 2319/33

See application file for complete search history.

(56) References Cited

U.S. PATENT DOCUMENTS

| | | | | |
|---|---|---|---|---|
| 5,846,936 | A * | 12/1998 | Felix ...................... | C07K 14/60 514/11.2 |
| 6,827,931 | B1 | 12/2004 | Donovan | |
| 8,512,984 | B2 | 8/2013 | Foster et al. | |
| 8,603,779 | B2 | 12/2013 | Foster et al. | |
| 8,614,069 | B2 | 12/2013 | Cossins et al. | |
| 8,778,634 | B2 | 7/2014 | Foster et al. | |
| 8,790,897 | B2 | 7/2014 | Quinn et al. | |
| 8,796,216 | B2 | 8/2014 | Johnstone et al. | |
| 2003/0180289 | A1* | 9/2003 | Foster ............. | A61K 47/48246 424/132.1 |
| 2005/0031648 | A1 | 2/2005 | Brin et al. | |
| 2006/0211619 | A1 | 9/2006 | Steward et al. | |
| 2008/0032928 | A1 | 2/2008 | Quinn et al. | |
| 2008/0032931 | A1 | 2/2008 | Steward et al. | |
| 2011/0070212 | A1* | 3/2011 | Jacky .................... | C07K 14/33 424/94.1 |
| 2011/0177053 | A1 | 7/2011 | Foster et al. | |
| 2012/0230975 | A1 | 9/2012 | Foster et al. | |
| 2014/0147429 | A1 | 5/2014 | Chaddock et al. | |
| 2014/0302006 | A1 | 10/2014 | Johnstone et al. | |

FOREIGN PATENT DOCUMENTS

| | | | |
|---|---|---|---|
| WO | 9742223 | A1 | 11/1997 |
| WO | 9807864 | A1 | 2/1998 |
| WO | 0153336 | A1 | 7/2001 |
| WO | 2004076634 | A2 | 9/2004 |

(Continued)

OTHER PUBLICATIONS

Foster et al, Engineered toxins: New therapeutics. vol. 51, Supplement, Jun. 1, 2008, pp. 47-48.*
Jungwirth et al, Inhibition of in vivo proliferation of androgen-independent prostate cancers by an antagonist of growth hormone-releasing hormone. Br J Cancer. 1997;75(11):1585-92.*
Chaddock et al, Retargeted Clostridial Endopeptidases: Inhibition of Nociceptive Neurotransmitter Release In Vitro, and Antinociceptive Activity in In Vivo Models of Pain. Movement Disorders vol. 19, Suppl. 8, 2004, pp. S42-S47.*
Binz et al, Clostridial Neurotoxins: Mechanism of Snare Cleavage and Outlook on Potential Substrate Specificity Reengineering. Toxins 2010, 2, 665-682.*

(Continued)

*Primary Examiner* — Sheridan Swope
(74) *Attorney, Agent, or Firm* — Gene J. Yao; Barnes & Thornburg LLP

(57) ABSTRACT

The present invention relates to a method for suppressing or treating cancer, in particular to a method for suppressing or treating one or more of colorectal cancer, breast cancer, prostate cancer and/or lung cancer. The therapy employs use of a non-cytotoxic protease, which is targeted to a growth hormone-secreting cell such as to a pituitary cell. When so delivered, the protease is internalised and inhibits secretion/transmission of growth hormone from said cell. The present invention also relates to polypeptides and nucleic acids for use in said methods.

14 Claims, 10 Drawing Sheets

Figure 1:
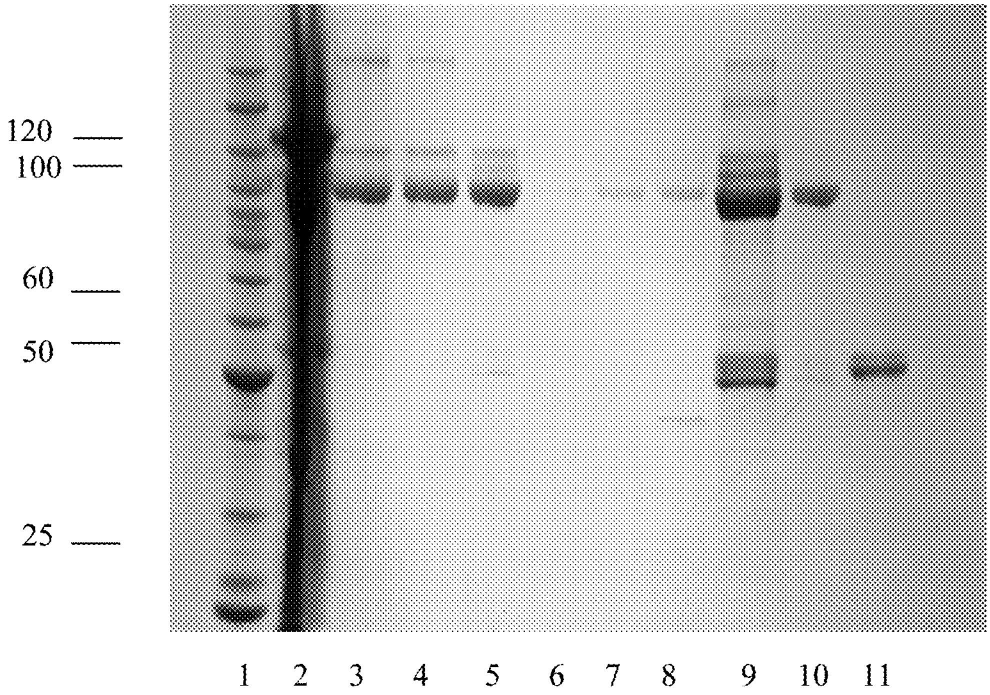

Specification includes a Sequence Listing.

(56) References Cited

FOREIGN PATENT DOCUMENTS

| | | | | |
|---|---|---|---|---|
| WO | 2005016953 A2 | 2/2005 | | |
| WO | 2005023309 A1 | 3/2005 | | |
| WO | 2006025976 A1 | 3/2006 | | |
| WO | 2006026780 A1 | 3/2006 | | |
| WO | 2006059093 A2 | 6/2006 | | |
| WO | 2006059113 A2 | 6/2006 | | |
| WO | 2006099590 A2 | 9/2006 | | |
| WO | WO2006099590 * | 9/2006 | ............. | C07K 14/33 |
| WO | 2007106115 A1 | 9/2007 | | |
| WO | 2007106799 A2 | 9/2007 | | |
| WO | 2008008803 A2 | 1/2008 | | |

OTHER PUBLICATIONS

Humeau et al, How botulinum and tetanus neurotoxins block neurotransmitter release. Biochimie 82 (2000) 427-446.*
Issued_Patents_AA database U.S. Pat. No. 5,846,936, Felix et al, 1998, SEQ ID No. 14. Alignment with SEQ ID No. 93.*
Matsuno et al, Functional and Morphological Analyses of Rab Proteins and the Soluble N-ethylmaleimide-sensitive Factor Attachment Protein Receptor (SNARE) System in the Secretion of Pituitary Hormones. Acta Histochemica Et Cytochemica vol. 36 (2003) No. 6 p. 501-506.*
Jacobsson et al, Botulinum neurotoxin F, a VAMP-specific endopeptidase, inhibits Ca-stimulated GH secretion from rat pituitary cells. Regulatory Peptides 71 (1997) 37-44.*
Mayo et al, Expression-cloning and sequence of a cDNA encoding human growth hormone-releasing factor. Nature 306 (5938), 86-88 (1983).*
Morel et al, Restricted Presence of the Growth Hormone-Releasing Hormone Receptor to Somatotropes in Rat and Human Pituitaries. Neuroendocrinology 1999;70:128-136.*
Veyrat-Durebex et al, 2005 Internalization and Trafficking of the Human and Rat Growth Hormone-Releasing Hormone Receptor. Journal of Cellular Physiology 203:335-344 (2005).*
Arai et al., "Design of the linkers which effectively separate domains of a bifunctional fusion protein", Protein Eng., Aug. 2001, 14(8): 529-32.
Frankel et al., "Characterization of diphtheria fusion proteins targeted to the human interleukin-3 receptor", Protein Eng., Aug. 2000, 13(8): 575-81.
Veyrat-Durebex et al., "Internalization and Trafficking of the Human and Rat Growth Hormone-Releasing Hormone Receptor", Journal of Cellular Physiology, 2005, 2003: 335-344.
J. L. Varga et al., Antagonist of Growth Hormone-Releasing Hormone (GHRH) in Cancer, Handbook of Biologically Active Peptides, 2006, pp. 483-489, Chapter 70, Elsevier.
U.S. Appl. No. 11/806,496, filed May 31, 2007, Issued.
U.S. Appl. No. 12/969,810, filed Dec. 16, 2010, Issued.
U.S. Appl. No. 13/059,695, filed Mar. 31, 2011, Issued.
U.S. Appl. No. 13/072,865, filed Mar. 28, 2011, Pending.
U.S. Appl. No. 13/212,868, filed Aug. 18, 2011, Issued.
U.S. Appl. No. 13/343,892, filed Jan. 5, 2012, Issued.
U.S. Appl. No. 13/418,453, filed Mar. 13, 2012, Issued.
U.S. Appl. No. 13/419,381, filed Mar. 13, 2012, Pending.
U.S. Appl. No. 14/117,286, filed Jan. 29, 2014, Pending.
U.S. Appl. No. 14/250,959, filed Apr. 11, 2014, Pending.
Schally, Andrew, et al, Antagonists of growth-hormone-releasing hormone: an emerging new therapy for cancer, Nature Clinical Practice, Jan. 2008, p. 33-41, vol. 4 No. 1.
Chaddock, J.A. et al., "Clostridial neurotoxins; structure-function led design of new therapeutics", Celluar and Moleccular Life Sciences. Jan. 16, 2006 vol. 63 pp. 540-551.
Jacobsson, et al. "Botulinum neurotoxin F, a VAMP-specific endopeptidase, inhibits Ca(2+)-stimulated GH secretion from rat pituitary cells" Regul Pept, vol. 71, No. 1, Jul. 23 1997, whole document.
Schally, et al. "Antagonists of growth hormone-releasing hormone in oncology" Current topics in Medicinal Chemistry, Bentham Science Publishers Ltd., Netherlands, vol. 9, No. 3, Mar. 1, 2006, pp. 163-170.
Foster et al., Re-engineering the target specificity of Clostridial neurotoxins—a route to novel therapeutics. Neurotox Res. Apr. 2006; 9(2-3):101-7.
Horvath et al., Pathology of Acromegaly. Neuroendocrinology. 2006, vol. 83 Issue 3/4, p. 161-165.
Yee, D. et al., "Insulin-like Growth Factor! Expression by Tumors of Neuroectodermal Origin with the t(11;22) Chromosomal Translocation, A Potential Autocrine Growth Factor," J. Clin. Invest. The American Society for Clinical Investigation, Inc., 0021-9738/90/12/1806/09, vol. 86, Dec. 1990, pp. 1806-1814. Retrieved from URL: https://www.doi.org/10.1172/JCI114910 [retrieved on Feb. 24, 2017].
Perry, J. K. et al., "The oncogenic potential of growth hormone", Growth Hormone & IGF Research, Science Direct, 16 (2006) pp. 277-259.
Singleton, J. R. et al., "Insulin-like Growth Factor I Receptor Prevents Apoptosis and Enhances Neuroblastoma Tumorigenesis", Cancer Research vol. 56, Oct. 1, 1996, pp. 4522-4529.
Kappel, C. C. et al. "Human Osteosarcoma Cell Lines Are Dependent on Insulin-like Growth Factor I for in Vitro Growth", Cancer Research vol. 54, May 15, 1994, pp. 2803-2807.
Weber, M. M. et al, "Overexpression of the Insulin-Like Growth Factor I Receptor in Human Colon Carcinomas" Cancer, Nov. 15, 2002, vol. 95, No. 1, pp. 2086-2095.
Werner, H. et al. "increased expression of the insulin-like growth factor I receptor gene, IGF1R; in Wilms tumor is correlated with modulation of IGF1R promoter activity by the WT1 Wilms tumor gene product," Proc. Natl. Acad. Sci. USA, Jun. 1993, vol. 90, pp. 5828-5832.
Shevah, O. et al. "Patients with congenital deficiency of IGF-I seem protected from the development of malignancies: A preliminary report", Growth Hormone & IGF Research, Official Journal of the Growth Hormone Research Society & the International IGF Research Society, vol. 17, No. 1, Feb. 2007, p. 54-57.
Waters, M. et al., "Does Growth Hormone Drive Breast and Other Cancers?", Endocrinology, Oct. 2007, vol. 148, No. 10, pp. 4533-4535.
Chan, J. et al., "Plasma Insulin-Like Growth Factor-I and Prostate Cancer Risk: A Prospective Study", Science, Jan. 23, 1998, vol. 279, pp. 563-566.
She N, Q. et al., "Advanced Rat Mammary Cancers Are Growth Hormone Dependent", Endocrinology, Oct. 2007, vol. 148, No. 10, pp. 4536-4544.
Laban, C. et al., "The GH-IGF-I axis and breast cancer", TRENDS in Endocrinology and Metabolism, Jan. 2003, vol. 14, No. 1 , pp. 28-34.
Ma, J. et al., "Prospective Study of Colorectal Cancer Risk in Men and Plasma Levels of Insulin-Like Growth Factor (IGF)-I and IGF-Binding Protein-3", Journal of the National Cancer institute, Apr. 7, 1999, vol. 91, No. 7, pp. 620-625.
Shaneyfelt, T. et al., "Hormonal Predictors of Prostate Cancer: A Meta-Analysis", Journal of Clinical Oncology, Feb. 2000, vol. 18, No. 4, pp. 847-853.
Hankinson, S. et al., "Circulating concentrations of insulin-like growth factor I and risk of breast cancer", The Lancet, May 9, 1998, vol. 351, pp. 1393-1396.
Jenkins, P. et al., "Clinical Perspective Acrornegaly and Cancer: A problem", The Journal of Clinical Endocrinology & Metabolism, Mar. 2001, vol. 86, No. 7, pp. 2935-2941.
Schally, A. et al., "Antagonist of growth-hormone-releasing hormone: an emerging new therapy for cancer", Nature Clinical Practice, Jan. 2008, vol. 4, No. 1, pp. 33-43.
Foster et al., Abstracts Toxins 2008/Toxicon 51 (2008) 1-54.
Busto et al., PNAS, 99:11866-11871 (2002).

* cited by examiner

SUPPRESSION OF PROSTATE CANCER USING A TARGETED CLOSTRIDIAL NEUROTOXIN

This application is a continuation of U.S. patent application Ser. No. 12/996,641, pending, which is a national stage application of International Application No. PCT/GB2009/050666, filed on Jun. 11, 2009. Each of the above referenced applications is incorporated by reference herein in its entirety.

Pursuant to the provisions of 37 C.F.R. § 1.52(e)(5), the sequence listing text file named 98374_Seq_Listing.txt, created on Apr. 9, 2014 and having a size of 652,334 bytes, and which is being submitted herewith, is incorporated by reference herein in its entirety.

The present invention relates to the suppression of the growth, maintenance, and progression of common cancers, in particular colorectal, prostate, breast and lung cancers.

Colorectal cancer is the third most common cancer in both men and women in the United States, according to the World Health Organization's April 2003 report on global cancer rates more than 940 000 new cases are diagnosed every year and nearly 500,000 deaths are reported worldwide each year. The overall 5-year survival rate from colon cancer is approximately 60% and nearly 60,000 people die of the disease each year in the United States.

Currently employed therapies depend mainly on the location of the tumour in the colon or rectum and the stage of the disease, and may involve a) surgery, b) chemotherapy, c) biological therapy or d) radiation therapy. Surgery to remove the primary tumour is the principal first-line treatment. However, common adverse side effects of surgery include bleeding from the surgery, blood clots in the legs, and damage to nearby organs during the operation.

Surgical options include: (i) bowel resection, which involves cutting into the abdomen to reach the area of the colon or rectum that is affected by the cancer.

The surgeon removes the cancer as well as the parts of the colon or rectum that are next to it. Then the two healthy ends of the colon or rectum are sewn back together; (ii) liver resection, which involves removal of the metastasis that has spread from a colorectal area to the liver, as well as parts of the liver that are next to the cancer. Up to half of the liver can be removed as long as the rest is healthy. Two other methods to destroy cancer cells in the liver include radio waves (radiofrequency ablation) and heat (microwave coagulation), and (iii) cryosurgery (also called cryotherapy) which employs the use of liquid nitrogen to freeze and destroy colorectal cancer that has spread to the liver. It is used when the tumours in the liver are small in size.

Chemotherapy is typically employed as an adjuvant to surgery to a minority of patients, usually those whose tumour has spread to lymph nodes, for whom the benefit of chemotherapy has been clearly established. However, side effects from chemotherapy include: nausea, vomiting, loss of appetite, hair loss, mouth sores, rash on the hands and feet, and also: risk of infection, bleeding or bruising from minor injuries, and anemia-related fatigue. Chemotherapy can be given in a variety of situations: (i) primary chemotherapy is typically used when colorectal cancer is advanced and has already spread to other parts of the body. In this case, surgery cannot eliminate the cancer, so at this time the physician usually recommends chemotherapy, which can shrink tumour nodules, alleviate symptoms, and prolong life; (ii) adjuvant chemotherapy is employed when chemotherapy is given after a cancer has been surgically removed. The surgery may not eliminate all the cancer, so the adjuvant chemotherapy treatment is often used to kill any cancer cells that may have been missed, such as cells that may have metastasized or spread to the liver; and (iii) neoadjuvant chemotherapy may be employed prior to surgery in order to shrink the tumour so the surgeon can completely remove the tumour with fewer complications. Chemotherapy is often given with radiation to make the radiation more effective.

Biological therapy can be prescribed to people having cancer, which has already spread. Current therapies include the use of: (i) biological response modifiers, which do not directly destroy the cancer, but instead trigger the immune system to react against the tumours. Biological response modifiers include cytokines such as interferons and interleukins. However, this strategy involves use of large administration doses by injection or infusion in the hope of stimulating the cells of the immune system to act more effectively. In addition, use of biological response modifiers is often associated with flu-like symptoms including fever, chills, nausea, and loss of appetite. Further undesirable side effects include: rashes or swelling at the site of injection, a blood pressure drop as a result of treatment, and fatigue; (ii) colony-stimulating factors, which stimulate the production of bone marrow cells such as red and white blood cells and platelets. Thus, colony-stimulating factors do not directly affect tumours but, instead, help support the immune system during cancer treatment. Regrettably, however, the use of colony-stimulating factors is associated with undesirable side effects such as bone pain, fatigue, fever, and loss of appetite; and (iii) tumour vaccines, which encourage the immune system to recognize cancer cells. Said vaccines are typically employed after the onset of cancer, and are therefore suppressive rather than preventative. Efficacy is poor, and the use of tumour vaccines is associated with muscle aches and low-grade fever.

A major difficulty with the treatment of colorectal cancers is that 20-25% of patients have clinical detectable liver metastases at the time of the initial diagnosis and a further 40-50% of patients develop liver metastases within three years after primary surgery, usually metastatic disease develops first in the liver.

Breast cancer is the most common type of cancer in women with the exception of non-melanoma skin cancers. It is estimated that almost 180,000 new cases of invasive breast cancer would be diagnosed among women in the United States in 2007. A woman has a lifetime risk of developing invasive breast cancer of about one in eight (13%).

Current therapies include: surgery, radiation therapy, chemotherapy, hormone therapy, and biological therapy. The choice of one therapy over another involves consideration of the size and location of the tumour, histological factors such as lymphatic invasion and histological subtype determination, the stage or extent of the disease, and the age and general health of the patient.

Surgery options include mastectomy or lumpectomy (also called breast conserving therapy or partial mastectomy), with or without lymph node removal. Unfortunately, patients who have undergone mastectomy often suffer from one or more of: wound infection and abscess, necrosis of skin flap, paresthesia of chest wall, phantom breast syndrome, post-surgical pain syndrome, seroma or lymphedema. Similarly, complications associated with lumpectomy include: injury or thrombosis of the axillary vein, seroma formation, lymphedema, impairment of shoulder movements, damage to the brachial plexus, and chest wall pain.

Radiation therapy is associated with complications such as: necrosis of the breast soft tissue, prolonged breast oedema, rib fracture, decreased shoulder mobility, brachial plexopathy with paresthesia and arm pain, lymphedema, angiosarcoma, lung cancer, coronary artery disease, and symptomatic pneumonitis.

Current chemotherapy options, however, go hand-in-hand with undesirable side effects such as: nausea, hair loss, early menopause, hot flushes, fatigue and temporarily lowered blood counts. In addition, more severe side-effects include: liver toxicity, hemorrhagic cystitis, amenorrhea, cerebellar ataxia, myocardial dysfunction, peripheral neuropathy, myelosuppression, neurotoxicity, alopecia, and pleural effusion.

Hormone therapies have to-date focussed on the use of Tamoxifen™, and/or the use of aromatase inhibitors such as Arimidex™, Aromasin™ and Femara™.

These therapeutic molecules act by suppressing hormone, especially oestrogen, activity and thus inhibit the growth of breast cancer cells that may remain after breast cancer surgery. Regrettably, however, hormone therapies are associated with undesirable side effects such as hot flushes and vaginal dryness. In particular, Tamoxifen™ treatment has been shown to increase the risk of endometrial cancer, induce perimenopausal symptoms, and increase the risk of developing cataracts.

Biological therapies have to-date focussed on the use of Herceptin™. However, the use of this therapeutic molecule is associated with adverse effects such as: cardiac toxicity, fever, chills, nausea, vomiting and pain can occur especially after the first infusion.

Prostate cancer is the second greatest cause of death in the United States in men dying from cancer and is the most common cancer diagnosed in American males. In the US it is estimated that 1 in 10 men will develop prostate cancer in their lifetime.

As with other cancer types, available treatments depend on a variety of factors, such as the grade and stage of the cancer, the age, and general health of the patient. Current therapies include: (i) watchful waiting based on PSA blood tests, which are performed regularly to check that the condition of a patient hasn't deteriorated. This approach is recommended for small, slow growing, non-aggressive cancers affecting elderly men where the cancer does not affect their life expectancy; (ii) prostatectomy (i.e. removal of the prostate), though this is associated with side effects such as: bladder control problems, urinary leakage, impotence, and anastomotic stricture; (iii) radiotherapy, such as external-beam radiation therapy (EBRT) using high-powered x-rays, though this therapy is associated with rectal problems, persistent bleeding, and rectal ulcer. Alternatively, radioactive seed implants, which are implanted directly into the prostate may be employed. This therapy is also known as brachytherapy, and delivers a lower dose of radiation (though over a longer period of time) than is typically achieved via external beams. Unfortunately, this type of therapy is associated with complications such as slow and painful urination, and impotence; (iv) hormone therapy, which is designed to prevent male sex hormones from stimulating cancer cell growth. This is typically achieved by chemical inhibition of male sex hormone secretion, or by surgical means (testicles removal). Unfortunately, these therapies are associated with side effects such as: breast enlargement, reduced sex drive, impotence, hot flushes, weight gain, and reduction in muscles and bone mass. In addition, some hormone therapy drugs have been shown to cause nausea, diarrhoea, fatigue, and liver damage; (v) chemotherapy—employing the same type of drugs as described above in the context of colorectal, breast or prostate cancer; and (vi) cryotherapy, which destroys the cancer cells by freezing the affected tissue. Regrettably, this therapy is limited due to difficulties in monitoring the extent of the freezing process, which frequently results in damage to tissues around the bladder and long term complications (e.g. injury to the rectum or the muscles controlling urination).

Lung cancer is the leading cause of cancer-related mortality for both men and women in the world. Worldwide lung cancer remains the most common malignancy, with an estimated 1.04 million new cases each year, it represents 12.8% of new cancer cases diagnosed. Lung cancer is the cause of 921,000 deaths each year in the world, accounting for almost 18% of cancer related deaths.

Current lung cancer therapies involve surgery, radiotherapy and chemotherapy, either separately or in combination. When employing said therapies, physicians take into account: the type of lung cancer (small cell or non-small cell), the size and position of the tumour, the stage of the tumour (presence of metastasis or not outside the lung), and the general health of the patient.

For non-small cell lung cancers (NSCLC), currently available treatments include: (i) chemotherapy—unfortunately, NSCLC is only moderately sensitive to chemotherapy. Single-agent therapy response rates are in the region of 15%, with newer agents (e.g. Gemcitabine™, Paclitaxel™, Docetaxel™, Vinorelbine™) having slightly higher response rates (20-25%). In addition, chemotherapy is associated with complications such as: a drop in the number of blood cells, nausea, vomiting, diarrhoea, sore mouth and mouth ulcers, hair loss, and fatigue; (ii) biological therapy-recent research efforts have focused heavily on identifying molecular targets and using this knowledge to develop molecular-targeted therapies. Whilst several molecular-targeted therapies are currently being developed and tested in NSCLC, these therapies are associated with undesirable side effects including: flu-like symptoms, such as: chills, fever, muscle aches, fatigue, loss of appetite, nausea, vomiting, and diarrhoea; (iii) radiation therapy. This type of therapy is typically employed as an adjuvant to surgery, or alone when surgical resection is not possible because of limited pulmonary reserve or the presence of comorbid conditions. Alone, radiation therapy, is only associated with 12-16% survival after 5-year in early stage NSCLC. Regrettably, complications are common, and include: nausea, fatigue, skin reaction, hair loss, persistent cough, dry or sore throat, and swallowing difficulties; (iv) combined chemo-radiotherapy-recently studies have shown limited survival in patients with unresectable stage III disease when treated with concurrent (rather than sequential) platinum-based chemotherapy and radiation therapy. As with the above-described cancer types, however, the use of chemotherapy and radiotherapy has a number of undesirable side effects; (v) surgery—this is typically employed when the tumour is at an early stage and/or if the tumour has not spread. Examples include: wedge resection, which involves the removal of a triangle-shaped slice of tissue. Wedge resection is used to remove a tumour and a small amount of normal tissue around it. When a slightly larger amount of tissue is taken, it is called a segmental resection; lobectomy, which involves the removal of a whole lobe (section) of the lung; and pneumonectomy, which involves the removal of one whole lung. The side effects encountered after these interventions include: pain, infection but also: pneumonia, bleeding, blood clots, and other infections. In addition, the perioperative mortality rate is 6% for pneumonectomy, 3% for lobectomy, and 1% for segmentectomy.

For Small Cell Lung Cancer (SCLC), currently available treatments include: (i) chemotherapy—single-agent chemotherapy shows a rate of response ranging from 17% to 50%. Combination chemotherapy is associated with superior response rates and survival, though major side effects include: myelosuppression, nephrotoxicity, tumour lysis syndrome (characterized by: hyperuricemia, hyperphosphatemia, hypocalcemia, dehydration, and hyperkalemia), spinal cord compression, and hyponatremia; (ii) radiation therapy—this therapy is only used to palliate symptoms, and patients invariably relapse; (iii) surgery—most patients with SCLC are treated non-surgically. The exceptions are a relatively small number of patients (<5%) who present very early stage disease confined to the lung without any lymph node involvement. Such patients usually undergo resection of lung tumours as an initial diagnostic procedure. However, even for these patients, surgery alone is not considered curative.

Patients with relapsed SCLC have an extremely poor prognosis, approximately 65-70% of patients with SCLC have disseminated disease at presentation. Extensive-stage SCLCs are currently uncurable, and patients with extensive disease have median survival duration of less than 1 year. Even patients presenting with localized disease (i.e. limited stage) have median survival duration of less than 2 years. The 5-year survival rate for SCLC is less than 20%.

Referring to all of the above-discussed, currently-available therapies (for each of discussed cancer types—colorectal, breast, prostate, and lung cancer), there is a further problem, namely tumour lysis syndrome (TLS). TLS is a very serious and sometimes life-threatening complication of cancer therapy. It can be defined as a constellation of metabolic abnormalities resulting from spontaneous or treatment-related tumour necrosis or fulminant apoptosis. The metabolic abnormalities observed in patients with TLS include: hyperkalemia, hyperuricemia, and hyperphosphatemia with secondary hypocalcemia; and can lead to acute renal failure (ARF).

Cancer (especially colorectal cancer, breast cancer, prostate cancer, and lung cancer) continues to pose a major problem for animal healthcare on a global scale. Accordingly, there is a need in the art for alternative and/or improved cancer therapeutics and therapies that address one or more of the above problems.

The present invention solves one or more of said problems, by providing a new category of non-cytotoxic, anti-cancer agent.

In more detail, a first aspect of the present invention provides a polypeptide for use in treating cancer, said polypeptide comprising:

a a non-cytotoxic protease, which protease is capable of cleaving a protein of the exocytic fusion apparatus in a growth hormone-secreting cell;

b. a Targeting Moiety (TM) that is capable of binding to a Binding Site on a growth hormone-secreting cell, which Binding Site is capable of undergoing endocytosis to be incorporated into an endosome within the growth hormone-secreting cell; and c. a translocation domain that is capable of translocating the protease from within an endosome, across the endosomal membrane and into the cytosol of the growth hormone-secreting cell.

In use, a polypeptide of the invention binds to a growth hormone-secreting cell. Thereafter, the translocation component effects transport of the protease component into the cytosol of the growth hormone-secreting cell. Finally, once inside, the protease inhibits the exocytic fusion process of the growth hormone-secreting cell. Thus, by inactivating the exocytic fusion apparatus of the growth hormone-secreting cell, the polypeptide of the invention inhibits the release/secretion of growth hormone therefrom.

The 'bioactive' component of the polypeptides of the present invention is provided by a non-cytotoxic protease. This distinct group of proteases act by proteolytically-cleaving intracellular transport proteins known as SNARE proteins (e.g. SNAP-25, VAMP, or Syntaxin)—see Gerald K (2002) "Cell and Molecular Biology" (4th edition) John Wiley & Sons, Inc. The acronym SNARE derives from the term Soluble NSF Attachment Receptor, where NSF means N-ethylmaleimide-Sensitive Factor. SNARE proteins are integral to intracellular vesicle formation, and thus to secretion of molecules via vesicle transport from a cell. Accordingly, once delivered to a desired target cell, the non-cytotoxic protease is capable of inhibiting cellular secretion from the target cell.

The principal target cells to which polypeptides of the present invention bind are normal, non-diseased, non-cancerous cells that secrete growth hormone. These cells are, however, distinct from the ultimate 'downstream' cancer cells that are treated in accordance with the present invention.

The present invention provides polypeptides that are capable of (and for use in) reducing/minimising systemic or serum levels of growth hormone and/or insulin-like growth factor (IGF-1). Also provided, are polypeptides for use in reducing/minimising tumour lysis syndrone (TLS).

The polypeptides of the present invention are particularly suited for use in treating one or more of: colorectal cancer, breast cancer, prostate cancer and/or lung cancer (e.g. SCLC or NSCLC); including their metastases, precancerous conditions and symptoms thereof. In this regard, 'treating' includes reducing, preventing or eliminating cancer cells or the spread thereof in the local, regional or systemic circulation.

Thus, in a related aspect of the present invention, there is provided a method for treating cancer in a patient, said method comprising administering to the patient a therapeutically effective amount of a polypeptide of the present invention. The present invention also provides a method for reducing growth hormone and/or IGF-1 levels (preferably systemic and/or serum levels) in a patient, said method comprising administering to the patient a therapeutically effective amount of a polypeptide of the present invention. By way of example, in one embodiment, the present invention permits maintenance of a basal level of growth hormone at a threshold of around 10 ng/ml, preferably less than 6 ng/ml, more preferably less than 4 or 5 ng/ml. In a normal person, daily growth hormone levels may typically peak around one hour after the onset of sleep at a level of approximately 35 ng/ml. In this regard, in one embodiment, the present invention permits said peak to be controlled at a threshold of around 25 ng/ml, preferably less than 20 ng/ml, more preferably less than 15 ng/ml. Also provided, is a method for reducing/minimising tumour lysis syndrone (TLS).

Without wishing to be bound by any theory, the present inventors believe that an elevated systemic level of growth hormone causes the level of systemic IGF-1 to become elevated, and that the latter is responsible for increased IGF-1R activation and an associated increase in oncogene activation, which in turn leads to increased cellular proliferation and the formation/growth of tumours.

Following administration of a polypeptide of the present invention, a decrease in the secretion of growth hormone (e.g. human GH) from the anterior part of pituitary is observed. Similarly, a reduction of the level of circulating IGF-1 level is observed. Said decrease in GH/IGF-1 level is correlated with shrinkage of the tumour. Thus, use of the polypeptides of the present invention provides a favourable environment for cancer treatment by removing one of the major counter-acting biological pathways.

Following administration, the regional and distant spread of the cancer is reduced or eliminated. In this regard, without wishing to be bound by any theory, the present inventors believe that the spread of a metastasis is inhibited by the polypeptides of the present invention, which lower of the circulatory concentration of IGF-1.

An advantage of the present invention is that, after treatment of the cancer, the pituitary functioning returns to normal. In other words, the present invention provides a short-acting therapy that has a minimal post-therapy effect on the pituitary. Thus, in contrast to current hypophysectomy therapies, the present invention avoids the need for complex and unpleasant post-treatment (typically, life-long) regimens to prevent complications resulting from the initial cancer treatment, such as: osteoporosis, short bowel syndrome, memory loss which can lead to Alzheimer's, arthritis, back pain, fibromyalgia and chronic fatigue.

The biologically active component of the polypeptides of the present invention is a non-cytotoxic protease. Non-cytotoxic proteases are a discrete class of molecules that do not kill cells; instead, they act by inhibiting cellular processes other than protein synthesis. Non-cytotoxic proteases are produced as part of a larger toxin molecule by a variety of plants, and by a variety of microorganisms such as *Clostridium* sp. and *Neisseria* sp.

Clostridial neurotoxins represent a major group of non-cytotoxic toxin molecules, and comprise two polypeptide chains joined together by a disulphide bond. The two chains are termed the heavy chain (H-chain), which has a molecular mass of approximately 100 kDa, and the light chain (L-chain), which has a molecular mass of approximately 50 kDa. It is the L-chain, which possesses a protease function and exhibits a high substrate specificity for vesicle and/or plasma membrane associated (SNARE) proteins involved in the exocytic process (eg. synaptobrevin, syntaxin or SNAP-25). These substrates are important components of the neurosecretory machinery.

*Neisseria* sp., most importantly from the species *N. gonorrhoeae*, and *Streptococcus* sp., most importantly from the species *S. pneumoniae*, produce functionally similar non-cytotoxic toxin molecules. An example of such a non-cytotoxic protease is IgA protease (see WO99/58571, which is hereby incorporated in its entirety by reference thereto).

Thus, the non-cytotoxic protease of the present invention is preferably a clostridial neurotoxin protease or an IgA protease.

Turning now to the Targeting Moiety (TM) component of the present invention, it is this component that binds the polypeptide of the present invention to a growth hormone-secreting cell, preferably to a pituitary cell and/or to an extrapituitary cell. In one embodiment, the TM binds to the anterior region of the pituitary gland, for example to a somatotroph and/or to a cell of the adenohypophysis.

Suitable TMs include: ligands to growth hormone-secreting cell receptors such as cytokines, growth factors, neuropeptides, lectins, and antibodies—this term includes monoclonal antibodies, and antibody fragments such as Fab, $F(ab)'_2$, Fv, ScFv, etc.

A TM of the invention binds to a receptor on a growth hormone-secreting cell, such as a pituitary cell. By way of example, the TM may bind to a leptin (OB) receptor and isoforms thereof, a ghrelin receptor, a somatostatin (sst) receptor (e.g. $sst_1$, $sst_2$, $sst_3$, $sst_4$ and $sst_5$ and splice variants thereof), an insulin growth factor (IGF) receptor (e.g. IGF-1), an erbB receptor (e.g. erbB1, erbB2, erbB3 and erbB4, and splice variants thereof), a VIP-glucagon-GRF-secretin superfamily receptor (including splice variants thereof) such as a pituitary adenylate cyclase activating peptide (PACAP) receptor (e.g. PAC, $VPAC_1$ and/or $VPAC_2$), an orexin (OX) receptor and splice variants (e.g. $OX_1$ and/or $OX_2$), an interleukin (IL) receptor (e.g. Il-1, IL-2, IL-6 and IL-10 receptor), a nerve growth factor (NTR) receptor (e.g. TrkA (NTR) and p75(NTR)), a vascular endothelial growth factor (VEGF) receptor (e.g. VEGFR1, VEGFR2 and VEGFR3), a bombesin receptor (eg. BRS-1, BRS-2, or BRS-3), a urotensin receptor, a melanin-concentrating hormone receptor 1, a prolactin releasing hormone receptor, a KiSS-1 receptor, a corticotropin-releasing factor receptor 1 and a growth hormone-releasing hormone (GHRH) receptor.

In one embodiment, a TM of the present invention binds to a leptin receptor. Suitable examples of such TMs include: leptin peptides such as a full-length leptin peptide (eg. $leptin_{167}$), and truncations or peptide analogues thereof such as $leptin_{22-167}$, $leptin_{70-95}$, and $leptin_{116-122}$.

In another embodiment, a TM of the present invention binds to a ghrelin receptor. Examples of suitable TMs in this regard include: ghrelin peptides such as full-length ghrelin (eg. $ghrelin_{117}$) and truncations or peptide analogues thereof such as $ghrelin_{24-117}$, and $ghrelin_{52-117}$; [Trp3, Arg5]-ghrelin (1-5), des-Gln-Ghrelin, cortistatin-8, His-D-Trp-Ala-Trp-D-Phe-Lys-$NH_2$, growth hormone releasing peptide (e.g. GHRP-6), or hexarelin.

In one embodiment, a TM of the present invention binds to a somatostatin (SST) receptor. By way of example, suitable TMs include: SST peptides and cortistatin (CST)-peptides, as well as peptide analogues thereof such as D-Phe-Phe-Phe-D-Trp-Lys-Thr-Phe-Thr-$NH_2$ (BIM 23052), D-Phe-Phe-Tyr-D-Trp-Lys-Val-Phe-D-Nal-$NH_2$ (BIM 23056) or c[Cys-Phe-Phe-D-Trp-Lys-Thr-Phe-Cys]-$NH_2$ (BIM-23268). Further examples include the SST peptides SST-14 and SST-28; as well as peptide and peptide analogues such as: octreotide, lanreotide, BIM23027, vapreotide, seglitide, and SOM230. These TMs are preferred TMs for binding to SST receptors, in particular to $sst_1$, $sst_2$, $sst_3$, $sst_4$ and $sst_5$ receptors.

In one embodiment, a TM of the present invention binds to insulin-like growth factor (IGF) receptor. Suitable examples include, for example IGF-1 peptides and IGF-2 peptides.

In one embodiment, a TM of the present invention binds to a VIP-glucagon-GRF-secretin superfamily receptor, such as to a PAC (eg. $PAC_1$) or to a VPAC (e.g. VPAC-1 or VPAC-2) receptor. Suitable examples of such TMs include pituitary adenylate cyclase-activating peptides (PACAP), vasoactive intestinal peptides (VIP), as well as truncations and peptide analogues thereof.

In one embodiment the TM is a VIP peptide including VIP-1 and VIP-2 peptides, for example VIP(1-28), or a truncation or peptide analogue thereof. These TMs demonstrate a selective binding to VPAC-1. Alternatively, a TM demonstrating a selective binding to VPAC2 may be employed, such as, for example mROM (see Yu et al., Peptides 27 (6) p 1359-66 (2006), which is hereby incorporated by reference thereto). In another embodiment, the TM may be a PACAP peptide, for example PACAP(1-38) or PACAP(1-27), or a truncation of peptide analogue thereof. These TMs are preferred TMs for binding to PAC (eg. PAC-1) receptors.

In another embodiment, a TM of the present invention binds to an orexin receptor (eg. $OX_1$ or $OX_2$ receptors). Examples of suitable TMs include: full-length orexin-A peptides and truncations or peptide analogues thereof, and orexin-B peptides and truncations or peptide analogues thereof.

In one embodiment, a TM of the present invention binds to an interleukin receptor. Suitable TM examples include: IL-1 peptides (e.g. IL-1α, IL-β, IL-18 peptides) and truncations or peptide analogues thereof, IL-2 peptides (e.g. IL-2, IL-3, IL-12, IL-23 peptides) and truncations or peptide analogues thereof, and IL-17 peptides (e.g. Il-17A, IL-17C peptides) and truncations or peptide analogues thereof.

In another embodiment, a TM of the present invention binds to an NGF receptor. Examples of suitable TMs include full-length NGF, and truncations or peptide analogues thereof.

In one embodiment, a TM of the present invention binds to a vasoactive epidermal growth factor (VEGF) receptor. Examples of suitable TMs include: VEGF peptide (e.g. VEGF-A, VEGF-B, VEGF-C, VEGF-D or VEGF-E and associated splice variants) and truncations or peptide analogues thereof, and placental growth factor (PIGF) and truncations or peptide analogues thereof.

In another embodiment, a TM of the present invention binds to an ErbB receptor. By way of example, the TM is selected from EGF peptides, transforming growth factor-α (TGF-α) peptides, chimeras of EGF and TGF-α, amphiregulin peptides, betacellulin peptides, epigen peptides, epiregulin peptides, heparin-binding EGF (HB-EGF) peptides, neuregulin (NRG) peptides such as NRG1α, NRG1β, NRG2α, NRG2β, NRG3, NRG4 and neuroregulin splice variants, tomoregulin 1 and 2 peptides, neuroglycan-C peptides, lin-3 peptides, vein peptides, gurken peptides, spitz peptides, or keren peptides; as well as truncations and peptide analogues thereof. There are 4 classes of ErbB receptor (termed ErbB1, erbB2, erbB3 and erbB4), which are also referred to as HER receptors. A number of variants of these receptors exist, which arise from alternate splicing and/or cleavage of the full-length receptor (eg EGFR v1 translation starts at aa543; EGFR vii deletion of aa521-603; EGFR v111 deletion of aa 6-273; EGFRvIII/Δ12-13 deletion of aa 6-273 and 409-520; EGFR vIV deletion of aa 959-1030; EGFR vV truncation at residue 958; EGFR TDM/2-7 tandem duplication of 6-273; EGFR TDM/18-25 tandem duplication of 664-1030; EGFR-TDM/18-26 tandem duplication of 664-1014). In addition, there are four ErbB4 receptor isoforms called erbB4 JM-a, erbB4 JM-b, erbB4 CYT-1 and erbB4 CYT-1.

Preferred TMs bind to ErbB receptors (eg. ErbB1, ErbB2, ErbB3, ErbB4) and splice variants thereof, in particular the ErbB1 receptor. ErbB TMs may also include proteins which contain EGF motifs with a splice site between the fourth and fifth cysteines within the six cysteine EGF-module, where this module is placed in close proximity to the transmembrane region of the potential ligand. For example, interphotoreceptor matrix proteoglycan-2 (IMP-2), meprin (MEP) 1α, MEP1β, mucin (MUC)3, MUC4, MUC12. and MUC17, as well as proteins with a T-knot scaffold such as potato carboxypeptidase inhibitor, and antibodies to ErbB receptors such as cetuximab, ABX-EGF, trastuzumab, or EMD72000. Further examples include chimeras generated by swapping domains (loop sequences and/or connecting amino acids) of different ErbB ligands, such as a mammalian erbB receptor ligand in which the B-loop sequence has replaced by those present in the insect (Drosophila) ErbB ligands, an ErbB ligand in which the C-loop sequence of EGF has been replaced by that of TGFα(44-50), EGF ligands in which one or more domain has been replaced by corresponding sequences in TGFα to create EGF/TGFα chimeras (e.g. E3T, T3E, E4T, T4E, T3E4T, T6E and E3T4E, and EGF chimeras in which the N-terminal TGFα sequence (WSHFND) or the neuregulin sequence (SHLVK) has been used to replace the N-terminal EGF sequence C-terminal of the first cysteine residue (NSDSE), T1E, and Biregulin. Yet further chimeras include EGF in which a domain has been replaced by an EGF-like domain of another protein, such as a blood coagulation, neural development or cell adhesion protein (e.g. Notch 3, Delta 1, EMR1, F4/80, EMR3 and EMR4 receptors).

In a further embodiment, a TM of the present invention binds to a melanin-concentrating hormone receptor 1. Examples of suitable TMs in this regard include: melanin-concentrating hormone (MCH) peptides such as full-length MCH, truncations and analogues thereof.

In another embodiment, a TM of the present invention binds to a prolactin releasing hormone receptor. An example of a suitable TM in this regard includes prolactin releasing peptide, truncations and analogues thereof.

In a further embodiment, a TM of the present invention binds to a KiSS-1 receptor. Examples of suitable TMs in this regard include Kisspeptin-10, Kisspeptin-54 peptides, truncations and analogues thereof.

In another embodiment, a TM of the present invention binds to a a corticotropin-releasing factor receptor 1. Example of a suitable TM in this regard includes corticotropin-releasing hormone, urocortin 1 and urocortin 2, including truncations and analogues thereof.

In another embodiment, a TM of the present invention binds to a growth-hormone-releasing hormone (GHRH) receptor. GHRH is also known as growth-hormone-releasing factor (GRF or GHRF) or somatocrinin. Suitable TM examples of the present invention include the full-length GHRH (1-44) peptide, and truncations or peptide analogues thereof such as GHRH(1-29); GHRH(1-37); hGHRH(1-40)-OH; [MeTyr1, Ala15,22, Nle27]-hGHRH(1-29)-NH2; [MeTyr1, Ala-8,9,15,22,28, Nle 27]-hGHRH(1-29)-NH2; cyclo (25-29)[MeTyr1, Ala15, DAsp25, NIle27, Orn29+++]-hGHRH(1-29)-NH2; (D-Tyr1)-GHRH (1-29)-NH2; (D-Ala2)-GHRH (1-29)-NH2; (D-Asp3)-GHRH (1-29)-NH2 (D-Ala4)-GHRH (1-29)-NH2; (D-Thr7)-GHRH (1-29)-NH2; (D-Asn8)-GHRH (1-29)-NH2; (D-Ser9)-GHRH (1-29)-NH2; (D-Tyr10)-GHRH (1-29)-NH2; (Phe4)-GHRH (1-29)-NH2; (pCI-Phe6)-GHRH (1-29)-NH2; (N—Ac-Tyr1)-GHRH (1-29)-NH2; (N—Ac-Tyr1, D-Ala2)-GHRH (1-29)-NH2; (N—Ac-D-Tyr1, D-Ala2)-GHRH (1-29)-NH2; (N—Ac-D-Tyr1, D-Ala 2, D-Asp3)-GHRH (1-29)-NH2; (D-Ala2, NLeu27)-GHRH (1-29)-NH2; (Hist D-Ala2, NLeu27)-GHRH (1-29)-NH2; (N—Ac-Hist, D-Ala2, N-Leu27)-GHRH (1-29)-NH2; (Hist D-Ala 2, D-Ala 4, Nleu27)-GHRH (1-29)-NH2; (D-Ala2, D-Asp3, D-Asn8, NLeu27)-GHRH (1-29)-NH2; (D-Asp3, D-Asn8, NLeu27)-GHRH (1-29)-NH2; [Hist NLeu27]-hGHRH(1-29)-NH2; [NLeu27]-hGHRH(1-29)-NH2; H-Tyr-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Ser-Arg-Gln-Gln-Gly-Glu-Ser-Asn-Gln-Glu-Arg-Gly-Ala-Arg-Ala-Arg-Leu-NH2 (SEQ ID NO: 88); H-Tyr-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Ser-Arg-NH2 (SEQ ID NO: 89); H-Tyr-D-Ala-Asp-Ala-Ile-Phe-Thr-Asn- Ser-Tyr-Arg-Lys-Val-Leu-Gly-Gln-Leu-Ser-Ala-Arg-Lys-Leu-Leu-Gln-Asp-Ile-Met-Ser-Arg-NH2 (SEQ ID NO: 90); H-Tyr-Ala-Asp-Ala-Ile-Phe-Thr-Asn-Ser-Tyr-Arg-Lys-Ile-Leu-Gly-Gln-Leu-Ser-Ala-Arg-Lys-Leu-Leu-Gln-Asp-Ile-Met-Asn-Arg-Gln-Gln-Gly-Glu-Arg-Asn-Gln-Glu-Gln-Gly-Ala-Lys-Val-Arg-Leu-NH2 (SEQ ID NO: 91); H-Tyr-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Asn-Arg-Gln-Gln-Gly-Glu-Arg-Asn-Gln-Glu-Gln-Gly-Ala-Lys-Val-Arg-Leu-NH2 (SEQ ID NO: 92); His-Val-Asp-Ala-Ile-Phe-Thr-Gln-Ser-Tyr-Arg-Lys-Val-Leu-Ala-Gln-Leu-Ser-Ala-Arg-Lys-Leu-Leu-Gln-Asp-Ile-Leu-Asn-Arg (SEQ ID NO: 93); and His-Val-Asp-Ala-Ile-Phe-Thr-Gln-Ser-Tyr-Arg-Lys-Val-Leu-Ala-Gln-Leu-Ser-Ala-Arg-Lys-Leu-Leu-Gln-Asp-Ile-Leu-Asn-Arg-Gln-Gln-Gly-Glu-Arg-Asn-Gln-Glu-Gln-Gly-Ala (SEQ ID NO: 94).

SEQ ID NO: 94 above is referred to herein as qGHRH. SEQ ID NO:93 above is referred to herein as qGHRH29.

In a further embodiment, the TM binds to a bombesin receptor (eg. BRS-1, BRS-2, or BRS-3). TMs for use in the present invention that bind to a bombesin receptor include: bombesin—a 14 amino acid peptide originally isolated from the skin of a frog (pGlu-Gln-Arg-Leu-Gly-Asn-Gln-Trp-Ala-Val-Gly-His-Leu-Met-NH2) (SEQ ID NO: 95); and the two known homologs in mammals, namely neuromedin B, and gastrin releasing peptide (GRP) such as porcine GRP-Ala-Pro-Val-Ser-Val-Gly-Gly-Gly-Thr-Val-Leu-Ala-Lys-Met-Tyr-Pro-Arg-Gly-Asn-His-Trp-Ala-Val-Gly-His-Leu-Met-NH2 (SEQ ID NO: 96), and human GRP-Val-Pro-Leu-Pro-Ala-Gly-Gly-Gly-Thr-Val-Leu-Thr-Lys-Met-Tyr-Pro-Arg-Gly-Asn-His-Trp-Ala-Val-Gly-His-Leu-Met-NH2 (SEQ ID NO: 97). Additional TMs include corresponding bombesin, neuromedin B and GRP truncations as well as peptide analogues thereof.

In another embodiment, a TM of the present invention binds to a urotensin receptor. Suitable TMs in this regard include urotensin peptides such as Urotensin-II (U-II), which is a cyclic neuropeptide, as well as truncations and peptide analogues thereof. The C-terminal cyclic region of U-II is strongly conserved across different species, and includes the six amino acid residues (-Cys Ple-Trp-Lys-Tyr-Cys-) (SEQ ID NO: 98), which is structurally similar to the central region of somatostatin-14 (-Phe-Trp-Lys-Thr) (SEQ ID NO: 99). Urotensin peptides suitable for use in the present invention include the U-II precursor peptides, such as prepro-urotensin-II (including the two human 124 and 139 isoforms thereof), and truncations and anlogues thereof such as the eleven residue mature peptide form.

According to a second aspect of the present invention, there is provided a composition of matter, namely a polypeptide comprising:

a a non-cytotoxic protease, which protease is capable of cleaving a protein of the exocytic fusion apparatus in a growth hormone-secreting cell;

b. a Targeting Moiety (TM) that is capable of binding to a Binding Site on a growth hormone-secreting cell, which Binding Site is capable of undergoing endocytosis to be incorporated into an endosome within the growth hormone-secreting cell; and d. a translocation domain that is capable of translocating the protease from within an endosome, across the endosomal membrane and into the cytosol of the growth hormone-secreting cell.

All of the features of the first aspect of the present invention apply equally to the above-described second aspect.

In a preferred embodiment of the first and/or second aspects of the present invention, the TM has a human peptide amino acid sequence. Thus, a preferred TM is, for example, a human GHRH peptide, a human CST peptide or a human SST peptide.

Polypeptide Preparation

The polypeptides of the present invention comprise 3 principal components: a 'bioactive' (ie. a non-cytotoxic protease); a TM; and a translocation domain. The general technology associated with the preparation of such fusion proteins is often referred to as re-targeted toxin technology. By way of exemplification, we refer to: WO94/21300; WO96/33273; WO98/07864; WO00/10598; WO01/21213; WO06/059093; WO00/62814; WO00/04926; WO93/15766; WO00/61192; and WO99/58571. All of these publications are herein incorporated by reference thereto.

In more detail, the TM component of the present invention may be fused to either the protease component or the translocation component of the present invention. Said fusion is preferably by way of a covalent bond, for example either a direct covalent bond or via a spacer/linker molecule. The protease component and the translocation component are preferably linked together via a covalent bond, for example either a direct covalent bond or via a spacer/linker molecule. Suitable spacer/linked molecules are well known in the art, and typically comprise an amino acid-based sequence of between 5 and 40, preferably between 10 and 30 amino acid residues in length.

In use, the polypeptides have a di-chain conformation, wherein the protease component and the translocation component are linked together, preferably via a disulphide bond.

The polypeptides of the present invention may be prepared by conventional chemical conjugation techniques, which are well known to a skilled person. By way of example, reference is made to Hermanson, G. T. (1996), Bioconjugate techniques, Academic Press, and to Wong, S. S. (1991), Chemistry of protein conjugation and cross-linking, CRC Press, Nagy et al., PNAS 95 p 1794-99 (1998). Further detailed methodologies for attaching synthetic TMs to a polypeptide of the present invention are provided in, for example, EP0257742. The above-mentioned conjugation publications are herein incorporated by reference thereto.

Alternatively, the polypeptides may be prepared by recombinant preparation of a single polypeptide fusion protein (see, for example, WO98/07864). This technique is based on the in vivo bacterial mechanism by which native clostridial neurotoxin (ie. holotoxin) is prepared, and results in a fusion protein having the following 'simplified' structural arrangement:

$NH_2$-[protease component]-[translocation component]-[TM]-COOH

According to WO98/07864, the TM is placed towards the C-terminal end of the fusion protein. The fusion protein is then activated by treatment with a protease, which cleaves at a site between the protease component and the translocation component. A di-chain protein is thus produced, comprising the protease component as a single polypeptide chain covalently attached (via a disulphide bridge) to another single polypeptide chain containing the translocation component plus TM.

Alternatively, according to WO06/059093, the TM component of the fusion protein is located towards the middle of the linear fusion protein sequence, between the protease cleavage site and the translocation component. This ensures that the TM is attached to the translocation domain (ie. as occurs with native clostridial holotoxin), though in this case the two components are reversed in order vis-à-vis native holotoxin. Subsequent cleavage at the protease cleavage site exposes the N-terminal portion of the TM, and provides the di-chain polypeptide fusion protein.

The above-mentioned protease cleavage sequence(s) may be introduced (and/or any inherent cleavage sequence removed) at the DNA level by conventional means, such as by site-directed mutagenesis. Screening to confirm the presence of cleavage sequences may be performed manually or with the assistance of computer software (e.g. the MapDraw program by DNASTAR, Inc.). Whilst any protease cleavage site may be employed (ie. clostridial, or non-clostridial), the following are preferred:

```
                                  (SEQ ID NO: 100)
Enterokinase (DDDDK↓)

                              (SEQ ID NO: 101/102)
Factor Xa (IEGR↓/IDGR↓)

                                  (SEQ ID NO: 103)
TEV(Tobacco Etch virus) (ENLYFQ↓G)

                                  (SEQ ID NO: 104)
Thrombin (LVPR↓GS)

                                  (SEQ ID NO: 105)
PreScission (LEVLFQ↓GP)
```

Additional protease cleavage sites include recognition sequences that are cleaved by a non-cytotoxic protease, for example by a clostridial neurotoxin. These include the SNARE (eg. SNAP-25, syntaxin, VAMP) protein recognition sequences that are cleaved by non-cytotoxic proteases such as clostridial neurotoxins. Particular examples are provided in US2007/0166332, which is hereby incorporated in its entirety by reference thereto.

Also embraced by the term protease cleavage site is an intein, which is a self-cleaving sequence. The self-splicing reaction is controllable, for example by varying the concentration of reducing agent present. The above-mentioned 'activation' cleavage sites may also be employed as a 'destructive' cleavage site (discussed below) should one be incorporated into a polypeptide of the present invention.

In a preferred embodiment, the fusion protein of the present invention may comprise one or more N-terminal and/or C-terminal located purification tags. Whilst any purification tag may be employed, the following are preferred:

His-tag (e.g. 6× histidine), preferably as a C-terminal and/or N-terminal tag

MBP-tag (maltose binding protein), preferably as an N-terminal tag

GST-tag (glutathione-S-transferase), preferably as an N-terminal tag

His-MBP-tag, preferably as an N-terminal tag

GST-MBP-tag, preferably as an N-terminal tag

Thioredoxin-tag, preferably as an N-terminal tag

CBD-tag (Chitin Binding Domain), preferably as an N-terminal tag.

One or more peptide spacer/linker molecules may be included in the fusion protein. For example, a peptide spacer may be employed between a purification tag and the rest of the fusion protein molecule.

Thus, a third aspect of the present invention provides a nucleic acid (e.g. DNA) sequence encoding a polypeptide as described above (i.e. the second aspect of the present invention).

Said nucleic acid may be included in the form of a vector, such as a plasmid, which may optionally include one or more of an origin of replication, a nucleic acid integration site, a promoter, a terminator, and a ribosome binding site.

The present invention also includes a method for expressing the above-described nucleic acid sequence (i.e. the third aspect of the present invention) in a host cell, in particular in *E. coli* or via a baculovirus expression system.

The present invention also includes a method for activating a polypeptide of the present invention, said method comprising contacting the polypeptide with a protease that cleaves the polypeptide at a recognition site (cleavage site) located between the non-cytotoxic protease component and the translocation component, thereby converting the polypeptide into a di-chain polypeptide wherein the non-cytotoxic protease and translocation components are joined together by a disulphide bond. In a preferred embodiment, the recognition site is not native to a naturally-occurring clostridial neurotoxin and/or to a naturally-occurring IgA protease.

The polypeptides of the present invention may be further modified to reduce or prevent unwanted side-effects associated with dispersal into non-targeted areas. According to this embodiment, the polypeptide comprises a destructive cleavage site. The destructive cleavage site is distinct from the 'activation' site (i.e. di-chain formation), and is cleavable by a second protease and not by the non-cytotoxic protease. Moreover, when so cleaved at the destructive cleavage site by the second protease, the polypeptide has reduced potency (e.g. reduced binding ability to the intended target cell, reduced translocation activity and/or reduced non-cytotoxic protease activity). For completeness, any of the 'destructive' cleavage sites of the present invention may be separately employed as an 'activation' site in a polypeptide of the present invention.

Thus, according to this embodiment, the present invention provides a polypeptide that can be controllably inactivated and/or destroyed at an off-site location.

In a preferred embodiment, the destructive cleavage site is recognised and cleaved by a second protease (i.e. a destructive protease) selected from a circulating protease (e.g. an extracellular protease, such as a serum protease or a protease of the blood clotting cascade), a tissue-associated protease (e.g. a matrix metalloprotease (MMP), such as an MMP of muscle), and an intracellular protease (preferably a protease that is absent from the target cell).

Thus, in use, should a polypeptide of the present invention become dispersed away from its intended target cell and/or be taken up by a non-target cell, the polypeptide will become inactivated by cleavage of the destructive cleavage site (by the second protease).

In one embodiment, the destructive cleavage site is recognised and cleaved by a second protease that is present within an off-site cell-type. In this embodiment, the off-site cell and the target cell are preferably different cell types. Alternatively (or in addition), the destructive cleavage site is recognised and cleaved by a second protease that is present at an off-site location (e.g. distal to the target cell). Accordingly, when destructive cleavage occurs extracellularly, the target cell and the off-site cell may be either the same or different cell-types. In this regard, the target cell and the off-site cell may each possess a receptor to which the same polypeptide of the invention binds.

The destructive cleavage site of the present invention provides for inactivation/destruction of the polypeptide when the polypeptide is in or at an off-site location. In this regard, cleavage at the destructive cleavage site minimises the potency of the polypeptide (when compared with an identical polypeptide lacking the same destructive cleavage site, or possessing the same destructive site but in an uncleaved form). By way of example, reduced potency includes: reduced binding (to a mammalian cell receptor) and/or reduced translocation (across the endosomal membrane of a mammalian cell in the direction of the cytosol), and/or reduced SNARE protein cleavage.

When selecting destructive cleavage site(s) in the context of the present invention, it is preferred that the destructive cleavage site(s) are not substrates for any proteases that may be separately used for post-translational modification of the polypeptide of the present invention as part of its manufacturing process. In this regard, the non-cytotoxic proteases of the present invention typically employ a protease activation event (via a separate 'activation' protease cleavage site, which is structurally distinct from the destructive cleavage site of the present invention). The purpose of the activation cleavage site is to cleave a peptide bond between the non-cytotoxic protease and the translocation or the binding components of the polypeptide of the present invention, thereby providing an 'activated' di-chain polypeptide wherein said two components are linked together via a disulphide bond.

Thus, to help ensure that the destructive cleavage site(s) of the polypeptides of the present invention do not adversely affect the 'activation' cleavage site and subsequent disulphide bond formation, the former are preferably introduced into polypeptide of the present invention at a position of at least 20, at least 30, at least 40, at least 50, and more preferably at least 60, at least 70, at least 80 (contiguous) amino acid residues away from the 'activation' cleavage site.

The destructive cleavage site(s) and the activation cleavage site are preferably exogenous (i.e. engineered/artificial) with regard to the native components of the polypeptide. In other words, said cleavage sites are preferably not inherent to the corresponding native components of the polypeptide. By way of example, a protease or translocation component based on BoNT/A L-chain or H-chain (respectively) may be engineered according to the present invention to include a cleavage site. Said cleavage site would not, however, be present in the corresponding BoNT native L-chain or H-chain. Similarly, when the Targeting Moiety component of the polypeptide is engineered to include a protease cleavage site, said cleavage site would not be present in the corresponding native sequence of the corresponding Targeting Moiety.

In a preferred embodiment of the present invention, the destructive cleavage site(s) and the 'activation' cleavage site are not cleaved by the same protease. In one embodiment, the two cleavage sites differ from one another in that at least one, more preferably at least two, particularly preferably at least three, and most preferably at least four of the tolerated amino acids within the respective recognition sequences is/are different.

By way of example, in the case of a polypeptide chimera containing a Factor Xa 'activation' site between clostridial L-chain and $H_N$ components, it is preferred to employ a destructive cleavage site that is a site other than a Factor Xa site, which may be inserted elsewhere in the L-chain and/or $H_N$ and/or TM component(s). In this scenario, the polypeptide may be modified to accommodate an alternative 'activation' site between the L-chain and $H_N$ components (for example, an enterokinase cleavage site), in which case a separate Factor Xa cleavage site may be incorporated elsewhere into the polypeptide as the destructive cleavage site. Alternatively, the existing Factor Xa 'activation' site between the L-chain and $H_N$ components may be retained, and an alternative cleavage site such as a thrombin cleavage site incorporated as the destructive cleavage site.

When identifying suitable sites within the primary sequence of any of the components of the present invention for inclusion of cleavage site(s), it is preferable to select a primary sequence that closely matches with the proposed cleavage site that is to be inserted. By doing so, minimal structural changes are introduced into the polypeptide. By way of example, cleavage sites typically comprise at least 3 contiguous amino acid residues. Thus, in a preferred embodiment, a cleavage site is selected that already possesses (in the correct position(s)) at least one, preferably at least two of the amino acid residues that are required in order to introduce the new cleavage site. By way of example, in one embodiment, the Caspase 3 cleavage site (DMQD) SEQ ID NO: 106 may be introduced. In this regard, a preferred insertion position is identified that already includes a primary sequence selected from, for example, Dxxx, xMxx, xxQx, xxxD, DMxx, DxQx, DxxD, xMQx, xMxD, xxQD, DMQx, xMQD, DxQD, and DMxD.

Similarly, it is preferred to introduce the cleavage sites into surface exposed regions. Within surface exposed regions, existing loop regions are preferred.

In a preferred embodiment of the present invention, the destructive cleavage site(s) are introduced at one or more of the following position(s), which are based on the primary amino acid sequence of BoNT/A. Whilst the insertion positions are identified (for convenience) by reference to BoNT/A, the primary amino acid sequences of alternative protease domains and/or translocation domains may be readily aligned with said BoNT/A positions.

For the protease component, one or more of the following positions is preferred: 27-31, 56-63, 73-75, 78-81, 99-105, 120-124, 137-144, 161-165, 169-173, 187-194, 202-214, 237-241, 243-250, 300-304, 323-335, 375-382, 391-400, and 413-423. The above numbering preferably starts from the N-terminus of the protease component of the present invention.

In a preferred embodiment, the destructive cleavage site (s) are located at a position greater than 8 amino acid residues, preferably greater than 10 amino acid residues, more preferably greater than 25 amino acid residues, particularly preferably greater than 50 amino acid residues from the N-terminus of the protease component. Similarly, in a preferred embodiment, the destructive cleavage site(s) are located at a position greater than 20 amino acid residues, preferably greater than 30 amino acid residues, more preferably greater than 40 amino acid residues, particularly preferably greater than 50 amino acid residues from the C-terminus of the protease component.

For the translocation component, one or more of the following positions is preferred: 474-479, 483-495, 507-543, 557-567, 576-580, 618-631, 643-650, 669-677, 751-767, 823-834, 845-859. The above numbering preferably acknowledges a starting position of 449 for the N-terminus of the translocation domain component of the present invention, and an ending position of 871 for the C-terminus of the translocation domain component.

In a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the N-terminus of the translocation component. Similarly, in a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the C-terminus of the translocation component.

In a preferred embodiment, the destructive cleavage site (s) are located at a position greater than 10 amino acid residues, preferably greater than 25 amino acid residues, more preferably greater than 40 amino acid residues, particularly preferably greater than 50 amino acid residues from the N-terminus of the TM component. Similarly, in a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the C-terminus of the TM component.

The polypeptide of the present invention may include one or more (e.g. two, three, four, five or more) destructive protease cleavage sites. Where more than one destructive cleavage site is included, each cleavage site may be the same or different. In this regard, use of more than one destructive cleavage site provides improved off-site inactivation. Similarly, use of two or more different destructive cleavage sites provides additional design flexibility.

The destructive cleavage site(s) may be engineered into any of the following component(s) of the polypeptide: the non-cytotoxic protease component; the translocation component; the Targeting Moiety; or the spacer peptide (if present). In this regard, the destructive cleavage site(s) are chosen to ensure minimal adverse effect on the potency of the polypeptide (for example by having minimal effect on the targeting/binding regions and/or translocation domain, and/or on the non-cytotoxic protease domain) whilst ensuring that the polypeptide is labile away from its target site/target cell.

Preferred destructive cleavage sites (plus the corresponding second proteases) are listed in the Table immediately below. The listed cleavage sites are purely illustrative and are not intended to be limiting to the present invention.

| Second | Destructive cleavage site recognition | Tolerated recognition sequence variance P4-P3-P2-P1-▼-P1'-P2'-P3' | | | | | | |
|---|---|---|---|---|---|---|---|---|
| protease | sequence | P4 | P3 | P2 | P1 | P1' | P2' | P3' |
| Thrombin | LVPR▼GS (SEQ ID NO: 104) | A, F, G, I, L, T, V or M | A, F, G, I, L, T, V, W or A | P | R | Not D or E | Not D or E | — |
| Thrombin | GR▼G | | | G | R | G | | |
| Factor Xa | IEGR▼ (SEQ ID NO: 101) | A, F, G, I, L, T, V or M | D or E | G | R | — | — | — |
| ADAM17 | PLAQA▼VRSSS (SEQ ID NO: 107) | | | | | | | |
| Human airway trypsin-like protease (HAT) | SKGR▼SLIGRV (SEQ ID NO: 108) | | | | | | | |
| ACE (peptidyl-dipeptidase A) | | — | — | — | — | Not P | Not D or E | N/A |
| Elastase (leukocyte) | MEA▼VTY (SEQ ID NO: 109) | M, R | E | A, H | V, T | V, T, H | Y | — |
| Furin | RXR/KR▼ (SEQ ID NO: 110) | R | X | R or K | R | | | |
| Granzyme | IEPD▼ (SEQ ID NO: 111) | I | E | P | D | — | — | — |
| Caspase 1 | | F, W, Y, L | — | H, A, T | D | Not P, E. D. Q. K or R | — | — |
| Caspase 2 | DVAD▼ (SEQ ID NO: 112) | D | V | A | D | Not P, E. D. Q. K or R | — | — |
| Caspase 3 | DMQD▼ (SEQ ID NO: 106) | D | M | Q | D | Not P, E. D. Q. K or R | — | — |
| Caspase 4 | LEVD▼ (SEQ ID NO: 113) | L | E | V | D | Not P, E. D. Q. K or R | — | — |

-continued

| Second protease | Destructive cleavage site recognition sequence | Tolerated recognition sequence variance P4-P3-P2-P1-▼-P1'-P2'-P3' | | | | | | |
|---|---|---|---|---|---|---|---|---|
| | | P4 | P3 | P2 | P1 | P1' | P2' | P3' |
| Caspase 5 | | L or W | E | H | D | — | — | — |
| Caspase 6 | | V | E | H or I | D | Not P, E. D. Q. K or R | — | — |
| Caspase 7 | DEVD▼ (SEQ ID NO: 114) | D | E | V | D | Not P, E. D. Q. K or R | — | — |
| Caspase 8 | | I or L | E | T | D | Not P, E. D. Q. K or R | — | — |
| Caspase 9 | LEHD▼ (SEQ ID NO: 115) | L | E | H | D | — | — | — |
| Caspase 10 | IEHD▼ (SEQ ID NO: 116) | I | E | H | D | — | — | — |

Matrix metalloproteases (MMPs) are a preferred group of destructive proteases in the context of the present invention. Within this group, ADAM17 (EC 3.4.24.86, also known as TACE), is preferred and cleaves a variety of membrane-anchored, cell-surface proteins to "shed" the extracellular domains. Additional, preferred MMPs include adamalysins, serralysins, and astacins.

Another group of preferred destructive proteases is a mammalian blood protease, such as Thrombin, Coagulation Factor VIIa, Coagulation Factor IXa, Coagulation Factor Xa, Coagulation Factor XIa, Coagulation Factor XIIa, Kallikrein, Protein C, and MBP-associated serine protease.

In one embodiment of the present invention, said destructive cleavage site comprises a recognition sequence having at least 3 or 4, preferably 5 or 6, more preferably 6 or 7, and particularly preferably at least 8 contiguous amino acid residues. In this regard, the longer (in terms of contiguous amino acid residues) the recognition sequence, the less likely non-specific cleavage of the destructive site will occur via an unintended second protease.

It is preferred that the destructive cleavage site of the present invention is introduced into the protease component and/or the Targeting Moiety and/or into the translocation component and/or into the spacer peptide. Of these four components, the protease component is preferred. Accordingly, the polypeptide may be rapidly inactivated by direct destruction of the non-cytotoxic protease and/or binding and/or translocation components.

Polypeptide Delivery

In use, the present invention employs a pharmaceutical composition, comprising a polypeptide, together with at least one component selected from a pharmaceutically acceptable carrier, excipient, adjuvant, propellant and/or salt.

The polypeptides of the present invention may be formulated for oral, parenteral, continuous infusion, inhalation or topical application. Compositions suitable for injection may be in the form of solutions, suspensions or emulsions, or dry powders which are dissolved or suspended in a suitable vehicle prior to use.

Local delivery means may include an aerosol, or other spray (eg. a nebuliser). In this regard, an aerosol formulation of a polypeptide enables delivery to the lungs and/or other nasal and/or bronchial or airway passages.

The preferred route of administration is selected from: systemic (eg. iv), laparoscopic and/or localised injection (transphenoidal injection directly into the pituitary).

In the case of formulations for injection, it is optional to include a pharmaceutically active substance to assist retention at or reduce removal of the polypeptide from the site of administration. One example of such a pharmaceutically active substance is a vasoconstrictor such as adrenaline. Such a formulation confers the advantage of increasing the residence time of polypeptide following administration and thus increasing and/or enhancing its effect.

The dosage ranges for administration of the polypeptides of the present invention are those to produce the desired therapeutic effect. It will be appreciated that the dosage range required depends on the precise nature of the polypeptide or composition, the route of administration, the nature of the formulation, the age of the patient, the nature, extent or severity of the patient's condition, contraindications, if any, and the judgement of the attending physician. Variations in these dosage levels can be adjusted using standard empirical routines for optimisation.

Suitable daily dosages (per kg weight of patient) are in the range 0.0001-1 mg/kg, preferably 0.0001-0.5 mg/kg, more preferably 0.002-0.5 mg/kg, and particularly preferably 0.004-0.5 mg/kg. The unit dosage can vary from less that 1 microgram to 30 mg, but typically will be in the region of 0.01 to 1 mg per dose, which may be administered daily or preferably less frequently, such as weekly or six monthly.

A particularly preferred dosing regimen is based on 2.5 ng of polypeptide as the 1× dose. In this regard, preferred dosages are in the range 1×-100× (i.e. 2.5-250 ng).

Fluid dosage forms are typically prepared utilising the polypeptide and a pyrogen-free sterile vehicle. The polypeptide, depending on the vehicle and concentration used, can be either dissolved or suspended in the vehicle. In preparing solutions the polypeptide can be dissolved in the vehicle, the solution being made isotonic if necessary by addition of sodium chloride and sterilised by filtration through a sterile filter using aseptic techniques before filling into suitable sterile vials or ampoules and sealing. Alternatively, if solution stability is adequate, the solution in its sealed containers may be sterilised by autoclaving. Advantageously additives such as buffering, solubilising, stabilising, preservative or bactericidal, suspending or emulsifying agents and or local anaesthetic agents may be dissolved in the vehicle.

Dry powders, which are dissolved or suspended in a suitable vehicle prior to use, may be prepared by filling pre-sterilised ingredients into a sterile container using aseptic technique in a sterile area. Alternatively the ingredients may be dissolved into suitable containers using aseptic technique in a sterile area. The product is then freeze dried and the containers are sealed aseptically.

Parenteral suspensions, suitable for intramuscular, subcutaneous or intradermal injection, are prepared in substantially the same manner, except that the sterile components are suspended in the sterile vehicle, instead of being dissolved and sterilisation cannot be accomplished by filtration. The components may be isolated in a sterile state or alternatively it may be sterilised after isolation, e.g. by gamma irradiation.

Advantageously, a suspending agent for example polyvinylpyrrolidone is included in the composition/s to facilitate uniform distribution of the components.

Definitions Section

Targeting Moiety (TM) means any chemical structure that functionally interacts with a Binding Site to cause a physical association between the polypeptide of the invention and the surface of a target cell (typically a mammalian cell, especially a human cell). The term TM embraces any molecule (ie. a naturally occurring molecule, or a chemically/physically modified variant thereof) that is capable of binding to a Binding Site on the target cell, which Binding Site is capable of internalisation (eg. endosome formation)—also referred to as receptor-mediated endocytosis. The TM may possess an endosomal membrane translocation function, in which case separate TM and Translocation Domain components need not be present in an agent of the present invention. Throughout the preceding description, specific TMs have been described. Reference to said TMs is merely exemplary, and the present invention embraces all variants and derivatives thereof, which possess a binding (i.e. targeting) ability to a Binding Site on a growth hormone-releasing cell, wherein the Binding Site is capable of internalisation.

The TM of the present invention binds (preferably specifically binds) to the target cell in question. The term "specifically binds" preferably means that a given TM binds to the target cell with a binding affinity (Ka) of $10^6$ $M^{-1}$ or greater, for example $10^7$ $M^{-1}$ or greater, $10^8$ $M^{-1}$ or greater, or $10^9$ $M^{-1}$ or greater.

Reference to TM in the present specification embraces fragments and variants thereof, which retain the ability to bind to the target cell in question. By way of example, a variant may have at least 80%, preferably at least 90%, more preferably at least 95%, and most preferably at least 97 or at least 99% amino acid sequence homology with the reference TM. Thus, a variant may include one or more analogues of an amino acid (e.g. an unnatural amino acid), or a substituted linkage. Also, by way of example, the term fragment, when used in relation to a TM, means a peptide having at least ten, preferably at least twenty, more preferably at least thirty, and most preferably at least forty amino acid residues of the reference TM. The term fragment also relates to the above-mentioned variants. Thus, by way of example, a fragment of the present invention may comprise a peptide sequence having at least 10, 20, 30 or 40 amino acids, wherein the peptide sequence has at least 80% sequence homology over a corresponding peptide sequence (of contiguous) amino acids of the reference peptide.

By way of example, ErbB peptide TMs may be modified to generate mutein ErbB ligands with altered properties such as increased stability. By way of example, ErbB TM muteins include ErbB peptides having amino acid modifications such as a valine residue at position 46 or 47 (EGFVal46 or 47), which confers stability to cellular proteases. ErbB TMs may also have amino acids deleted or additional amino acids inserted. This includes but is not limited to EGF having a deletion of the two C-terminal amino acids and a neutral amino acid substitution at position 51 (particularly EGF51Gln51; see US20020098178A1), and EGF with amino acids deleted (e.g. rEGF2-48; rEGF3-48 and rEGF4-48). Fragments of ErbB TMs may include fragments of TGFα which contain predicted β-turn regions (e.g. a peptide of the sequence Ac-C-H-S-G-Y-V-G-A-R-C-O-OMe) (SEQ ID NO: 118), fragments of EGF such as [Ala20]EGF(14-31), and the peptide YHWYGYTPQNVI (SEQ ID NO: 119) or GE11. All of the above patent specifications are incorporated herein by reference thereto.

By way of further example, somatostatin (SST) and cortistatin (CST) have high structural homology, and bind to all known SST receptors. Full-length SST has the amino acid sequence:

(SEQ ID NO: 120)
MLSCRLQCALAALSIVLALGCVTGAPSDPRLRQFLQKSLAAAAGKQELAK

YFLAELLSEPNQTENDALEPEDLSQAAEQDEMRLELQRSANSNPAMAPRE

RKAGCKNFFWKTFTSC

Full-length CST has the amino acid sequence:

(SEQ ID NO: 121)
MYRHKNSWRLGLKYPPSSKEETQVPKTLISGLPGRKSSSRVGEKLQSAH

KMPLSPGLLLLLLSGATATAALPLEGGPTGRDSEHMQEAAGIRKSSLLT

FLAWWFEWTSQASAGPLIGEEAREVARRQEGAPPQQSARRDRMPCRNFF

WKTFSSCK

Reference to these TMs includes the following fragments (and corresponding variants) thereof:

(SEQ ID NO: 122)
NFFWKTF;

(SEQ ID NO: 123)
(R or K)NFFWKTF;

(SEQ ID NO: 124)
C(R or K)NFFWKTF;

(SEQ ID NO: 125)
(P or G)C(R or K)NFFWKTF;

(SEQ ID NO: 126)
NFFWKTF(S or T);

(SEQ ID NO: 127)
NFFWKTF(S or T)S;

(SEQ ID NO: 128)
NFFWKTF(S or T)SC;

-continued (SEQ ID NO: 129)
(R or K)NFFWKTF(S or T);

(SEQ ID NO: 130)
(R or K)NFFWKTF(S or T)S;

(SEQ ID NO: 131)
(R or K)NFFWKTF(S or T)SC;

(SEQ ID NO: 132)
C(R or K)NFFWKTF(S or T);

(SEQ ID NO: 133)
C(R or K)NFFWKTF(S or T)S;

(SEQ ID NO: 134)
C(R or K)NFFWKTF(S or T)SC;

(SEQ ID NO: 135)
(P or G)C(R or K)NFFWKTF(S or T);

(SEQ ID NO: 136)
(P or G)C(R or K)NFFWKTF(S or T)S;or (SEQ ID NO: 137)
(P or G)C(R or K)NFFWKTF(S or T)SC.

With regard to the above sequences, where a (P or G) alternative is given, a P is preferred in the case of a CST TM, whereas a G is preferred in the case of an SST TM. Where an (R or K) alternative is given, an R is preferred in the case of a CST TM, whereas a K is preferred in the case of an SST TM. Where an (S or T) alternative is given, an S is preferred in the case of a CST TM, whereas a T is preferred in the case of an SST TM.

Preferred fragments comprise at least 7 or at least 10 amino acid residues, preferably at least 14 or at least 17 amino acid residues, and more preferably at least 28 or 29 amino acid residues. By way of example, preferred sequences include:

(SEQ ID NO: 138)
SANSNPAMAPRERKAGCKNFFWKTFTSC (SST-28);

(SEQ ID NO: 139)
AGCKNFFWKTFTSC (SST-14);

(SEQ ID NO: 140)
QEGAPPQQSARRDRMPCRNFFWKTFSSCK (CST-29);

(SEQ ID NO: 141)
QERPPLQQPPHRDKKPCKNFFWKTFSSCK (CST-29);

(SEQ ID NO: 142)
QERPPPQQPPHLDKKPCKNFFWKTFSSCK (CST-29)

(SEQ ID NO: 143)
DRMPCRNFFWKTFSSCK (CST-17);

(SEQ ID NO: 144)
PCRNFFWKTFSSCK (CST-14);
and (SEQ ID NO: 145)
PCKNFFWKTFSSCK (CST-14)

The TM may comprise a longer amino acid sequence, for example, at least 30 or 35 amino acid residues, or at least 40 or 45 amino acid residues, so long as the TM is able to bind to a normal GH-secreting cell, preferably to an SST or to a CST receptor on a normal GH-secreting cell. In this regard, the TM is preferably a fragment of full-length SST or CST, though including at least the core sequence "NFFWKTF" or one of the above-defined primary amino acid sequences.

By way of further example, GHRH peptides of the present invention include:

(SEQ ID NO: 146)
YADAIFTASYRKVLGQLSARKLLQDILSR;

(SEQ ID NO: 147)
YADAIFTASYRNVLGQLSARKLLQDILSR;

(SEQ ID NO: 148)
YADAIFTNSYRKVLGQLSARKLLQDIM;

(SEQ ID NO: 149)
YADAIFTNSYRKVLGQLSARKLLQDIMS;

(SEQ ID NO: 150)
ADAIFTNSYRKVLGQLSARKLLQDIMSR;

(SEQ ID NO: 151)
YADAIFTNSYRKVLGQLSARKLLQDIMSRQQGESNQERGARARL;

(SEQ ID NO: 152)
YADAIFTNSYRKVLGQLSARKLLQDIMSRQQGESNQERGA;

(SEQ ID NO: 153)
YADAIFTNAYRKVLGQLSARKLLQDIMSR;

(SEQ ID NO: 154)
YADAIFTNSYRKVLGQLSARKALQDIMSR;

(SEQ ID NO: 155)
YADAIFTASYKKVLGQLSARKLLQDIMSR;

(SEQ ID NO: 156)
YADAIFTASYKRVLGQLSARKLLQDIMSR;

(SEQ ID NO: 157)
YADAIFTASYNKVLGQLSARKLLQDIMSR;

(SEQ ID NO: 158)
YADAIFTASYRKVLGQLSAKKLLQDIMSR;

(SEQ ID NO: 159)
YADAIFTASYKKVLGQLSAKKLLQDIMSR;

(SEQ ID NO: 160)
YADAIFTASYRKVLGQLSANKLLQDIMSR;

(SEQ ID NO: 161)
YADAIFTASYRNVLGQLSARKLLQDIMSR;

(SEQ ID NO: 162)
YADAIFTASYRKVLGQLSARNLLQDIMSR;

(SEQ ID NO: 163)
YADAIFEASYRKVLGQLSARKLLQDIMSR;

(SEQ ID NO: 164)
YADAIFTASERKVLGQLSARKLLQDIMSR;

(SEQ ID NO: 165)
YADAIFTASYRKELGQLSARKLLQDIMSR;

(SEQ ID NO: 166)
YADAIFTASYRKVLGQLSARKLLQDIMSR;

(SEQ ID NO: 167)
YADAIFTESYRKVLGQLSARKLLQDIMSR;

(SEQ ID NO: 168)
YADAIFTNSYRKVLAQLSARKLLQDIM;

(SEQ ID NO: 169)
YADAIFTNSYRKVLAQLSARKLLQDIMSR;

(SEQ ID NO: 174)
YADAIFTASYRKVLAQLSARKLLQDIMSR;

(SEQ ID NO: 175)
YADAIFTAAYRKVLAQLSARKALQDIASR;

-continued (SEQ ID NO: 176)
YADAIFTAAYRKVLAQLSARKALQDIMSR;

(SEQ ID NO: 177)
HVDAIFTQSYRKVLAQLSARKLLQDILNRQQGERNQEQGA;

(SEQ ID NO: 178)
HVDAIFTQSYRKVLAQLSARKALQDILSRQQG;

(SEQ ID NO: 179)
HVDAIFTSSYRKVLAQLSARKLLQDILSR;

(SEQ ID NO: 180)
HVDAIFTTSYRKVLAQLSARKLLQDILSR;

(SEQ ID NO: 181)
YADAIFTQSYRKVLAQLSARKALQDILNR;

(SEQ ID NO: 182)
YADAIFTQSYRKVLAQLSARKALQDILSR.

It is routine to confirm that a TM binds to the selected target cell. For example, a simple radioactive displacement experiment may be employed in which tissue or cells representative of a growth hormone-secreting cell are exposed to labelled (eg. tritiated) TM in the presence of an excess of unlabelled TM. In such an experiment, the relative proportions of non-specific and specific binding may be assessed, thereby allowing confirmation that the TM binds to the target cell. Optionally, the assay may include one or more binding antagonists, and the assay may further comprise observing a loss of TM binding. Examples of this type of experiment can be found in Hulme, E. G. (1990), Receptor-binding studies, a brief outline, pp. 303-311, In Receptor biochemistry, A Practical Approach, Ed. E. G. Hulme, Oxford University Press.

In the context of the present invention, reference to a peptide TM (e.g. GHRH peptide, or leptin peptide) embraces peptide analogues thereof, so long as the analogue binds to the same receptor as the corresponding 'reference' TM. Said analogues may include synthetic residues such as:

ß-Nal=ß-naphthylalanine
ß-Pal=ß-pyridylalanine
hArg(Bu)=N-guanidino-(butyl)-homoarginine
hArg(Et)=N,N'-guanidino-(dimethyl)-homoarginine
hArg($CH_2CF_3$)$_2$=N,N'-guanidino-bis-(2,2,2,-trifluoroethyl)-homoarginine
hArg($CH_3$, hexyl)=N,N'-guanidino-(methyl, hexyl)-homoarginine
Lys(Me)=$N^e$-methyllysine
Lys(iPr)=$N^e$-isopropyllysine
AmPhe=aminomethylphenylalanine
AChxAla=aminocyclohexylalanine
Abu=α-aminobutyric acid
Tpo=4-thiaproline
MeLeu=N-methylleucine
Orn=ornithine
Nle=norleucine
Nva=norvaline
Trp(Br)=5-bromo-tryptophan
Trp(F)=5-fluoro-tryptophan
Trp($NO_2$)=5-nitro-tryptophan
Gaba=γ-aminobutyric acid
Bmp=J-mercaptopropionyl
Ac=acetyl
Pen-pencillamine By way of example, the above peptide analogue aspect is described in more detail with reference to specific peptide TMs, such as SST peptides, GHRH peptides, bombesin peptides, ghrelin peptides, and urotensin peptides, though the same principle applies to all TMs of the present invention.

Somatostatin analogues, which can be used to practice the present invention include, but are not limited to, those described in the following publications, which are hereby incorporated by reference: Van Binst, G. et al. Peptide Research 5: 8 (1992); Horvath, A. et al. Abstract, "Conformations of Somatostatin Analogs Having Antitumor Activity", 22nd European peptide Symposium, Sep. 13-19, 1992, Interlaken, Switzerland; U.S. Pat. No. 5,506,339; EP0363589; U.S. Pat. Nos. 4,904,642, 4,871,717; 4,725,577; 4,684,620; 4,650,787; 4,585,755; 4,725,577; 4,522,813; 4,369,179, 4,360,516; 4,328,214; 4,316,890; 4,310,518; 4,291,022; 4,238,481; 4,235,886; 4,211,693; 4,190,648; 4,146,612; 4,133,782; 5,506,339; 4,261,885; 4,282,143; 4,190,575; 5,552,520; EP0389180; EP0505680; U.S. Pat. No. 4,603,120; EP0030920; U.S. Pat. No. 4,853,371; WO90/12811; WO97/01579; WO91/18016; WO98/08529 and WO98/08528; WO/0075186 and WO00/06185; WO99/56769; and FR 2,522,655. Each of these publications is incorporated in its entirety by reference thereto.

Methods for synthesizing analogues are well documented, as illustrated, for example, by the patents cited above. For example, synthesis of H-D-Phe-Phe-Phe-D-Trp-Lys-Thr-Phe-Thr-NH2, can be achieved by following the protocol set forth in Example 1 of EP0395417A1. Similarly, synthesis analogues with a substituted N-terminus can be achieved, for example, by following the protocol set forth in WO88/02756, EP0329295, and U.S. Pat. No. 5,240,561.

The use of linear SST analogues are also included within the scope of this invention, for example: H-D-Phe-p-chloro-Phe-Tyr-D-Trp-Lys-Thr-Phe-Thr-NH2; H-D-Phe-p-N02-Phe-Tyr-D-Trp-Lys-Val-Phe-Thr-NH2; H-D-*Nal-p-chloro-Phe-Tyr-D-Trp-Lys-Val-Phe-Thr-NH2; H-D-Phe-Phe-Phe-D-Trp-Lys-Thr-Phe-Thr-NH2; H-D-Phe-Phe-Tyr-D-Trp-Lys-Val-Phe-Thr-NH2; H-D-Phe-p-chloro-Phe-Tyr-D-Trp-Lys-Val-Phe-Thr-NH2; and H-D-Phe-Ala-Tyr-D-Trp-Lys-Val-Ala-D-beta-Nal-NH2.

One or more chemical moieties, eg. a sugar derivative, mono or poly-hydroxy (C2-12) alkyl, mono or poly-hydroxy (C2-12) acyl groups, or a piperazine derivative, can be attached to a SST analogue, e.g. to the N-terminus amino acid—see WO88/02756, EP0329295, and U.S. Pat. No. 5,240,561.

GHRH peptide analogues date back to the 1990s, and include the 'standard antogonist' [Ac-Tyr', D-Arg2jhGH-RH 0-29) Nha. U.S. Pat. No. 4,659,693 discloses GH-RH antagonistic analogs which contain certain N,N'-dialkykomega-guanidino alpha-amino acyl residues in position 2 of the GH-RH (1-29) sequence, Additional examples are provided in WO91/16923, U.S. Pat. Nos. 5,550,212, 5,942,489, 6,057,422 U.S. Pat. Nos. 5,942,489, 6,057,422, WO96/032126, WO96/022782, WO96/016707, WO94/011397, WO94/011396, each of which is herein incorporated by reference thereto.

Examples of bombesin analogues suitable for use in the present invention include TMs comprising: D-Phe-Gln-Trp-Ala-Val-Gly-His-Leu-Met-$NH_2$ (code named BIM-26218), D-Phe-Gln-Trp-Ala-Val-Gly-His-Leu-Leu-$NH_2$ (code named BIM-26187); D-Cps-Gln-Trp-Ala-Val-Gly-His-Leu-φ [$CH_2NH$]-Phe-$NH_2$ (code named BIM-26159), and D-Phe-Gln-Trp-Ala-Val-Gly-His-Leu-φ [$CH_2NH$]-Cpa-$NH_2$ (code named BIM-26189); D-Phe-Gln-Trp-Ala-Val-N-methyl-D-Ala-His-Leu-methylester, and D-$F_g$-Phe-Gln-Trp-Ala-Val-D-Ala-His-Leu-methylester.

Bombesin analogues include peptides derived from the naturally-occurring, structurally-related peptides, namely; bombesin, neuromedin B, neuromedin C, litorin, and GRP. The relevant amino acid sequences of these naturally occurring TM peptides are listed below:

Bombesin (last 10 aa's):
(SEQ ID NO: 182)
Gly-Asn-Gln-Trp-Ala-Val-Gly-His-Leu-Met-$NH_2$ Neuromedin B:
(SEQ ID NO: 183)
Gly-Asn-Leu-Trp-Ala-Thr-Gly-His-Phe-Met-$NH_2$ Neuromedin C:
(SEQ ID NO: 184)
Gly-Asn-His-Trp-Ala-Val-Gly-His-Leu-Met-$NH_2$ Litorin:
(SEQ ID NO: 185)
pGlu-Gln-Trp-Ala-Val-Gly-His-Phe-Met-$NH_2$ Human GRP (last 10 aa's):
(SEQ ID NO: 184)
Gly-Asn-His-Trp-Ala-Val-Gly-His-Leu-Met-$NH_2$ Analogs suitable for use in the present invention are described in U.S. Pat. No. 502,438, filed Mar. 30, 1990, U.S. Pat. No. 397,169, filed Aug. 21, 1989, U.S. Pat. No. 376,555, filed Jul. 7, 1989, U.S. Pat. No. 394,727, filed Aug. 16, 1989; U.S. Pat. No. 317,941, filed Mar. 2, 1989, U.S. Pat. No. 282,328, filed Dec. 9, 1988, U.S. Pat. No. 257,998, filed Oct. 14, 1988, U.S. Pat. No. 248,771, filed Sep. 23, 1988; U.S. Pat. No. 207,759, filed Jun. 16, 1988, U.S. Pat. No. 204,171, filed Jun. 8, 1988, U.S. Pat. No. 173,311, filed Mar. 25, 1988, U.S. Pat. No. 100,571, filed Sep. 24, 1987; and U.S. Pat. No. 520,225, filed May 9, 1990, U.S. Pat. No. 440,039, filed Nov. 21, 1989. All these applications are hereby incorporated by reference. Bombesin analogs are also described in Zachary et al., Proc. Nat. Aca. Sci. 82:7616 (1985); Heimbrook et al., "Synthetic Peptides: Approaches to Biological Problems", UCLA Symposium on Mol. and Cell. Biol. New Series, Vol. 86, ed. Tarn and Kaiser; Heinz-Erian et al., Am. J. Physiol. G439 (1986); Martinez et al., J. Med. Chem. 28:1874 (1985); Gargosky et al., Biochem. J. 247:427 (1987); Dubreuil et al. Drug Design and Delivery, Vol 2:49, Harwood Academic Publishers, GB (1987); Heikkila et al., J. Biol. Chem. 262:16456 (1987); Caranikas et al., J. Med. Chem. 25:1313 (1982); Saeed et al., Peptides 10:597 (1989); Rosell et al., Trends in Pharmacological Sciences 3:211 (1982); Lundberg et al., Proc. Nat, Aca. Sci, 80:1120, (1983); Engberg et al., Nature 293:222 (1984); Mizrahi et al., Euro. J. Pharma. 82:101 (1982); Leander et al., Nature 294:467 (1981); Woll et al., Biochem. Biophys. Res. Comm. 155:359 (1988); Rivier et al., Biochem. 17:1766 (1978); Cuttitta et al., Cancer Surveys 4:707 (1985); Aumelas et al., Int. J. Peptide Res. 30:596 (1987); all of which are also hereby incorporated by reference.

The analogs can be prepared by conventional techniques, such as those described in WO92/20363 and EP0737691. Additional bombesin analogues are described in, for example, WO89/02897, WO91/17181, WO90/03980 and WO91/02746, all of which are herein incorporated by reference thereto.

Examples of ghrelin analogues suitable for use as a TM of the present invention comprise: Tyr-DTrp-DLys-Trp-DPhe-$NH_2$, Tyr-DTrp-Lys-Trp-DPhe-$NH_2$, His-DTrp-DLys-Trp-DPhe-$NH_2$, His-DTrp-DLys-Phe-DTrp-$NH_2$, His-DTrp-DArg-Trp-DPhe-$NH_2$, His-DTrp-DLys-Trp-DPhe-Lys-$NH_2$, DesaminoTyr-DTrp-Ala-Trp-DPhe-$NH_2$, DesaminoTyr-DTrp-DLys-Trp-DPhe-$NH_2$. DeaminoTyr-DTrp-Ser-Trp-DPhe-Lys-$NH_2$, DesaminoTyr-DTrp-Ser-Trp-DPhe-$NH_2$, His-DTrp-DTrp-Phe-Met-$NH_2$, Tyr-DTrp-DTrp-Phe-Phe-$NH_2$, Glyψ[$CH_2$NH]-DβNal-Ala-Trp-DPhe-Lys-$NH_2$, Glyψ[CH2NH]-DbetaNal-DLyS-TrP-DPhe-Lys-$NH_2$, DAla-DbetaNal-DLys-DTrp-Phe-Lys-$NH_2$, His-DbetaNal-DLys-Trp-DPhe-Lys-$NH_2$, Ala-His-DTrp-DLys-Trp-DPhe-Lys-$NH_2$, Alaφ[$CH_2$NH]-DbetaNal-Ala-Trp-DPhe-Lys-$NH_2$, DbetaNal-Ala-Trp-DPhe-Ala-$NH_2$, DAla-DcyclohexylAla-Ala-Phe-DPhe-Nle-$NH_2$, DcyclohexylAla-Ala-Phe-DTrp-Lys-$NH_2$, DAla-DbetaAla-Thr-DThr-Lys-$NH_2$, DcyclohexylAla-Ala-Trp-DPhe-$NH_2$, DAla-DbetaNal-Ala-Ala-DAla-Lys-$NH_2$, DbetaNal-Ala-Trp-DPhe-Leu-$NH_2$, His-DTrp-Phe-Trp-DPhe-Lys-$NH_2$, DAla-DbetaNal-DAla-DTrp-Phe-Lys-$NH_2$, pAla-Trp-DAla-DTrp-Phe-$NH_2$, His-Trp-DAla-DTrp-Phe-Lys$NH_2$, DLys-DβNal-Ala-Trp-DPhe-Lys-$NH_2$, DAla-DbetaNal-DLys-DTrp-Phe-Lys-$NH_2$, Tyr-DAla-Phe-Aib-$NH_2$, Tyr-DAla-Sar-NMePhe-$NH_2$, αγAbu-DTrp-DTrp-Ser-$NH_2$, αγAbu-DTrp-DTrp-Lys-$NH_2$, αγAbu-DTrp-DTrp-Orn-$NH_2$, aAbu-DTrp-DTrp-Orn-$NH_2$, DThr-DαNal-DTrp-DPro-Arg-$NH_2$, DAla-Ala-DAla-DTrp-Phe-Lys-$NH_2$, Alaψ[$CH_2$NH]His-DTrp-Ala-Trp-DPhe-Lys-$NH_2$, Lys-DHis-DTrp-Phe-$NH_2$, γAbu-DTrp-DTrp-Orn-$NH_2$, inip-Trp-Trp-Phe-$NH_2$, Ac-DTrp-Phe-DTrp-Leu-$NH_2$, Ac-DTrp-Phe-DTrp-Lys-$NH_2$, Ac-DTrp-DTrp-Lys-$NH_2$, DLys-Tyr-DTrp-DTrp-Phe-Lys-$NH_2$, Ac-DbetaNal-Leu-Pro-$NH_2$, pAla-Trp-DTrp-DTrp-Orn-$NH_2$, DVal-DαNal-DTrp-Phe-Arg-$NH_2$, DLeu-DαNal-DTrp-Phe-Arg-$NH_2$, CyclohexylAla-DαNal-DTrp-Phe-Arg-$NH_2$, DTp-DαNal-DTrp-Phe-Arg-$NH_2$, DAla-DβNal-DPro-Phe-Arg-$NH_2$, Ac-DαNal-DTrp-Phe-Arg-$NH_2$. DαNal-DTrp-Phe-Arg-$NH_2$, His-DTrp-DTrp-Lys-$NH_2$, Ac-DpNal-DTrp-$NH_2$, αAib-DTrp-DcyclohexylAla-$NH_2$, αAib-DTrp-DAla-cyclohexylAla-$NH_2$, DAla-Dcyclohexyl-Ala-Ala-Ala-Phe-DPhe-Nle-$NH_2$, DPhe-Ala-Phe-DPal-$NH_2$, DPhe-Ala-Phe-DPhe-Lys-$NH_2$, DLys-Tyr-DTrp-DTrp-Phe-$NH_2$, Ac-DLys-Tyr-DTrp-DTrp-Phe-$NH_2$, Arg-DTrp-Leu-Tyr-Trp-Pro(cyclic Arg-Pro), Ac-DβNal-PicLys-ILys-DPhe-NH2, DPal-Phe-DTrp-Phe-Met-$NH_2$, DPhe-Trp-DPhe-Phe-Met-$NH_2$, DPal-Trp-DPhe-Phe-Met-$NH_2$, pAla-Pal-DTrp-DTrp-Orn-$NH_2$, αγAbu-Trp-DTrp-DTrp-Orn-$NH_2$, βAla-Trp-DTrp-DTrp-Lys-$NH_2$, γAbu-Trp-DTrp-DTrp-Orn-$NH_2$, Ava-Trp-DTrp-DTrp-Orn-$NH_2$, DLys-Tyr-DTrp-Ala-Trp-DPhe-$NH_2$, His-DTrp-DArg-Trp-DPhe-$NH_2$, <Glu-His-Trp-DSer-DArg-$NH_2$, DPhe-DPhe-DTrp-Met-DLys-$NH_2$, 0-(2-methylallyl)benzophonone oxime, (R)-2-amino-3-(1H-1-indol-3-yl)-1-(4-phenylpiperidin-1-yl)propan-1-one, N—((R)-1-((R)-1-((S)-3-(1H-indol-3-yl)-1-oxo-1-(4-phenylpiperidin-1-yl)propan-2-ylamino)-6-amino-1-oxohexan-2-ylamino)-3-hydroxy-1-oxopropan-2-yl) benzamide, (S)—N—((S)-3-(1H-indol-3-yl)-1-oxo-1-(4-phenylpiperidin-1-yl)propan-2-yl)-6-acetamido-2-((S)-2-amino-3-(benzyloxy)propanamido)hexanamide, (S)—N—((R)-3-(1H-indol-3-yl)-1-oxo-1-(4-phenylpiperidin-1-yl) propan-2-yl)-2-((S)-2-acetamido-3-(benzyloxy) propanamido)-6-aminohexanamide, (R)—N-(3-(1H-indol-3-yl)-1-(4-(2-methoxyphenyl)piperidin-1-yl)-1-oxopropan-2-yl)-4-aminobutanamide, (R)—N-(3-(1H-indol-3-yl)-1-(4-(2-methoxyphenyl)piperidin-1-yl)-1-oxopropan-2-yl)-2-amino-2-methylpropanamide, methyl 3-(p-tolylcarbanoyl)-2-naphthoate, ethyl 3-(4-(2-methoxyphenyl)piperidine-1-carbonyl)-2-naphthoate, 3-(2-methoxyphenylcarbamoyl)-2-naphthoate, (S)-2,4-diamino-N—((R)-3-(naphthalen-2-ylmethoxy)-1-oxo-1-(4-phenylpiperidin-1-yl)propan-2-yl) butanamide, naphthalene-2,3-diylbis((4-(2-methoxyphenyl) piperazin-1-yl)methanone), (R)-2-amino-N-(3-(benzyloxy)-1-oxo-1-(4-phenylpiperazin-1-yl)propan-2-yl)-2- methylpropanamide, or (R)-2-amino-3-(benzyloxy)-1-(4-phenylpiperazin-1-yl)propan-1-one.

Examples of urotensin analogues suitable for use as a TM of the present invention comprise: Cpa-c [D-Cys-Phe-Trp-Lys-Thr-Cys]-Val-NH2; and Asp-c[Cys-Phe-Trp-Lys-Tyr-Cys]-Val-OH.

The polypeptides of the present invention lack a functional $H_C$ domain of a clostridial neurotoxin. Accordingly, said polypeptides are not able to bind rat synaptosomal membranes (via a clostridial $H_C$ component) in binding assays as described in Shone et al. (1985) Eur. J. Biochem. 151, 75-82. In a preferred embodiment, the polypeptides preferably lack the last 50 C-terminal amino acids of a clostridial neurotoxin holotoxin. In another embodiment, the polypeptides preferably lack the last 100, preferably the last 150, more preferably the last 200, particularly preferably the last 250, and most preferably the last 300 C-terminal amino acid residues of a clostridial neurotoxin holotoxin. Alternatively, the Hc binding activity may be negated/reduced by mutagenesis—by way of example, referring to BoNT/A for convenience, modification of one or two amino acid residue mutations (W1266 to L and Y1267 to F) in the ganglioside binding pocket causes the $H_C$ region to lose its receptor binding function. Analogous mutations may be made to non-serotype A clostridial peptide components, e.g. a construct based on botulinum B with mutations (W1262 to L and Y1263 to F) or botulinum E (W1224 to L and Y1225 to F). Other mutations to the active site achieve the same ablation of $H_C$ receptor binding activity, e.g. Y1267S in botulinum type A toxin and the corresponding highly conserved residue in the other clostridial neurotoxins. Details of this and other mutations are described in Rummel et al (2004) (Molecular Microbiol. 51:631-634), which is hereby incorporated by reference thereto.

In another embodiment, the polypeptides of the present invention lack a functional $H_C$ domain of a clostridial neurotoxin and also lack any functionally equivalent TM. Accordingly, said polypeptides lack the natural binding function of a clostridial neurotoxin and are not able to bind rat synaptosomal membranes (via a clostridial $H_C$ component, or via any functionally equivalent TM) in binding assays as described in Shone et al. (1985) Eur. J. Biochem. 151, 75-82.

In one embodiment, the TM is preferably not a Wheat Germ Agglutinin (WGA) peptide.

The $H_C$ peptide of a native clostridial neurotoxin comprises approximately 400-440 amino acid residues, and consists of two functionally distinct domains of approximately 25 kDa each, namely the N-terminal region (commonly referred to as the $H_{CN}$ peptide or domain) and the C-terminal region (commonly referred to as the $H_{CC}$ peptide or domain). This fact is confirmed by the following publications, each of which is herein incorporated in its entirety by reference thereto: Umland TC (1997) Nat. Struct. Biol. 4: 788-792; Herreros J (2000) Biochem. J. 347: 199-204; Halpern J (1993) J. Biol. Chem. 268: 15, pp. 11188-11192; Rummel A (2007) PNAS 104: 359-364; Lacey DB (1998) Nat. Struct. Biol. 5: 898-902; Knapp (1998) Am. Cryst. Assoc. Abstract Papers 25: 90; Swaminathan and Eswaramoorthy (2000) Nat. Struct. Biol. 7: 1751-1759; and Rummel A (2004) Mol. Microbiol. 51(3), 631-643. Moreover, it has been well documented that the C-terminal region ($H_{CC}$), which constitutes the C-terminal 160-200 amino acid residues, is responsible for binding of a clostridial neurotoxin to its natural cell receptors, namely to nerve terminals at the neuromuscular junction—this fact is also confirmed by the above publications. Thus, reference throughout this specification to a clostridial heavy-chain lacking a functional heavy chain $H_C$ peptide (or domain) such that the heavy-chain is incapable of binding to cell surface receptors to which a native clostridial neurotoxin binds means that the clostridial heavy-chain simply lacks a functional $H_{CC}$ peptide. In other words, the $H_{CC}$ peptide region is either partially or wholly deleted, or otherwise modified (e.g. through conventional chemical or proteolytic treatment) to inactivate its native binding ability for nerve terminals at the neuromuscular junction.

Thus, in one embodiment, a clostridial $H_N$ peptide of the present invention lacks part of a C-terminal peptide portion ($H_{CC}$) of a clostridial neurotoxin and thus lacks the $H_C$ binding function of native clostridial neurotoxin. By way of example, in one embodiment, the C-terminally extended clostridial $H_N$ peptide lacks the C-terminal 40 amino acid residues, or the C-terminal 60 amino acid residues, or the C-terminal 80 amino acid residues, or the C-terminal 100 amino acid residues, or the C-terminal 120 amino acid residues, or the C-terminal 140 amino acid residues, or the C-terminal 150 amino acid residues, or the C-terminal 160 amino acid residues of a clostridial neurotoxin heavy-chain. In another embodiment, the clostridial $H_N$ peptide of the present invention lacks the entire C-terminal peptide portion ($H_{CC}$) of a clostridial neurotoxin and thus lacks the $H_C$ binding function of native clostridial neurotoxin. By way of example, in one embodiment, the clostridial $H_N$ peptide lacks the C-terminal 165 amino acid residues, or the C-terminal 170 amino acid residues, or the C-terminal 175 amino acid residues, or the C-terminal 180 amino acid residues, or the C-terminal 185 amino acid residues, or the C-terminal 190 amino acid residues, or the C-terminal 195 amino acid residues of a clostridial neurotoxin heavy-chain. By way of further example, the clostridial $H_N$ peptide of the present invention lacks a clostridial $H_{CC}$ reference sequence selected from the group consisting of:

Botulinum type A neurotoxin—amino acid residues (Y1111-L1296)

Botulinum type B neurotoxin—amino acid residues (Y1098-E1291)

Botulinum type C neurotoxin—amino acid residues (Y1112-E1291)

Botulinum type D neurotoxin—amino acid residues (Y1099-E1276)

Botulinum type E neurotoxin—amino acid residues (Y1086-K1252)

Botulinum type F neurotoxin—amino acid residues (Y1106-E1274)

Botulinum type G neurotoxin—amino acid residues (Y1106-E1297)

Tetanus neurotoxin—amino acid residues (Y1128-D1315).

The above-identified reference sequences should be considered a guide as slight variations may occur according to sub-serotypes.

The protease of the present invention embraces all non-cytotoxic proteases that are capable of cleaving one or more proteins of the exocytic fusion apparatus in eukaryotic cells.

The protease of the present invention is preferably a bacterial protease (or fragment thereof). More preferably the bacterial protease is selected from the genera *Clostridium* or *Neisseria/Streptococcus* (e.g. a clostridial L-chain, or a neisserial IgA protease preferably from *N. gonorrhoeae* or *S. pneumoniae*).

The present invention also embraces variant non-cytotoxic proteases (ie. variants of naturally-occurring protease molecules), so long as the variant proteases still demonstrate the requisite protease activity. By way of example, a variant may have at least 70%, preferably at least 80%, more preferably at least 90%, and most preferably at least 95 or at least 98% amino acid sequence homology with a reference protease sequence. Thus, the term variant includes non-cytotic proteases having enhanced (or decreased) endopeptidase activity—particular mention here is made to the increased $K_{cat}/K_m$ of BoNT/A mutants Q161A, E54A, and K165L see Ahmed, S. A. (2008) Protein J. DOI 10.1007/s10930-007-9118-8, which is incorporated by reference thereto. The term fragment, when used in relation to a protease, typically means a peptide having at least 150, preferably at least 200, more preferably at least 250, and most preferably at least 300 amino acid residues of the reference protease. As with the TM 'fragment' component (discussed above), protease 'fragments' of the present invention embrace fragments of variant proteases based on a reference sequence.

The protease of the present invention preferably demonstrates a serine or metalloprotease activity (e.g. endopeptidase activity). The protease is preferably specific for a SNARE protein (e.g. SNAP-25, synaptobrevin/VAMP, or syntaxin).

Particular mention is made to the protease domains of neurotoxins, for example the protease domains of bacterial neurotoxins. Thus, the present invention embraces the use of neurotoxin domains, which occur in nature, as well as recombinantly prepared versions of said naturally-occurring neurotoxins.

Exemplary neurotoxins are produced by clostridia, and the term clostridial neurotoxin embraces neurotoxins produced by *C. tetani* (TeNT), and by *C. botulinum* (BoNT) serotypes A-G, as well as the closely related BoNT-like neurotoxins produced by *C. baratii* and *C. butyricum*. The above-mentioned abbreviations are used throughout the present specification. For example, the nomenclature BoNT/A denotes the source of neurotoxin as BoNT (serotype A). Corresponding nomenclature applies to other BoNT serotypes.

BoNTs are the most potent toxins known, with median lethal dose (LD50) values for mice ranging from 0.5 to 5 ng/kg depending on the serotype. BoNTs are adsorbed in the gastrointestinal tract, and, after entering the general circulation, bind to the presynaptic membrane of cholinergic nerve terminals and prevent the release of their neurotransmitter acetylcholine. BoNT/B, BoNT/D, BoNT/F and BoNT/G cleave synaptobrevin/vesicle-associated membrane protein (VAMP); BoNT/C, BoNT/A and BoNT/E cleave the synaptosomal-associated protein of 25 kDa (SNAP-25); and BoNT/C cleaves syntaxin.

BoNTs share a common structure, being di-chain proteins of ~150 kDa, consisting of a heavy chain (H-chain) of ~100 kDa covalently joined by a single disulphide bond to a light chain (L-chain) of ~50 kDa. The H-chain consists of two domains, each of ~50 kDa. The C-terminal domain ($H_C$) is required for the high-affinity neuronal binding, whereas the N-terminal domain ($H_N$) is proposed to be involved in membrane translocation. The L-chain is a zinc-dependent metalloprotease responsible for the cleavage of the substrate SNARE protein.

The term L-chain fragment means a component of the L-chain of a neurotoxin, which fragment demonstrates a metalloprotease activity and is capable of proteolytically cleaving a vesicle and/or plasma membrane associated protein involved in cellular exocytosis.

Examples of suitable protease (reference) sequences include:

Botulinum type A neurotoxin—amino acid residues (1-448)
Botulinum type B neurotoxin—amino acid residues (1-440)
Botulinum type C neurotoxin—amino acid residues (1-441)
Botulinum type D neurotoxin—amino acid residues (1-445)
Botulinum type E neurotoxin—amino acid residues (1-422)
Botulinum type F neurotoxin—amino acid residues (1-439)
Botulinum type G neurotoxin—amino acid residues (1-441)
Tetanus neurotoxin—amino acid residues (1-457)
IgA protease—amino acid residues (1-959)*
*Pohlner, J. et al. (1987). Nature 325, pp. 458-462, which is hereby incorporated by reference thereto.

The above-identified reference sequence should be considered a guide as slight variations may occur according to sub-serotypes. By way of example, US 2007/0166332 (hereby incorporated by reference thereto) cites slightly different clostridial sequences:

Botulinum type A neurotoxin—amino acid residues (M1-K448)
Botulinum type B neurotoxin—amino acid residues (M1-K441)
Botulinum type C neurotoxin—amino acid residues (M1-K449)
Botulinum type D neurotoxin—amino acid residues (M1-R445)
Botulinum type E neurotoxin—amino acid residues (M1-R422)
Botulinum type F neurotoxin—amino acid residues (M1-K439)
Botulinum type G neurotoxin—amino acid residues (M1-K446)
Tetanus neurotoxin—amino acid residues (M1-A457)

A variety of clostridial toxin fragments comprising the light chain can be useful in aspects of the present invention with the proviso that these light chain fragments can specifically target the core components of the neurotransmitter release apparatus and thus participate in executing the overall cellular mechanism whereby a clostridial toxin proteolytically cleaves a substrate. The light chains of clostridial toxins are approximately 420-460 amino acids in length and comprise an enzymatic domain. Research has shown that the entire length of a clostridial toxin light chain is not necessary for the enzymatic activity of the enzymatic domain. As a non-limiting example, the first eight amino acids of the BoNT/A light chain are not required for enzymatic activity. As another non-limiting example, the first eight amino acids of the TeNT light chain are not required for enzymatic activity. Likewise, the carboxyl-terminus of the light chain is not necessary for activity. As a non-limiting example, the last 32 amino acids of the BoNT/A light chain (residues 417-448) are not required for enzymatic activity. As another non-limiting example, the last 31 amino acids of the TeNT light chain (residues 427-457) are not required for enzymatic activity. Thus, aspects of this embodiment can include clostridial toxin light chains comprising an enzymatic domain having a length of, for example, at least 350 amino acids, at least 375 amino acids, at least 400 amino acids, at least 425 amino acids and at least 450 amino acids. Other aspects of this embodiment can include clostridial toxin light chains comprising an enzymatic domain having a length of, for example, at most 350 amino acids, at most 375 amino acids, at most 400 amino acids, at most 425 amino acids and at most 450 amino acids.

The non-cytotoxic protease component of the present invention preferably comprises a BoNT/A, BoNT/B or BoNT/D serotype L-chain (or fragment or variant thereof).

The polypeptides of the present invention, especially the protease component thereof, may be PEGylated—this may help to increase stability, for example duration of action of the protease component. PEGylation is particularly preferred when the protease comprises a BoNT/A, B or $C_1$ protease. PEGylation preferably includes the addition of PEG to the N-terminus of the protease component. By way of example, the N-terminus of a protease may be extended with one or more amino acid (e.g. cysteine) residues, which may be the same or different. One or more of said amino acid residues may have its own PEG molecule attached (e.g. covalently attached) thereto. An example of this technology is described in WO2007/104567, which is incorporated in its entirety by reference thereto.

A Translocation Domain is a molecule that enables translocation of a protease into a target cell such that a functional expression of protease activity occurs within the cytosol of the target cell. Whether any molecule (e.g. a protein or peptide) possesses the requisite translocation function of the present invention may be confirmed by any one of a number of conventional assays.

For example, Shone C. (1987) describes an in vitro assay employing liposomes, which are challenged with a test molecule. Presence of the requisite translocation function is confirmed by release from the liposomes of $K^+$ and/or labelled NAD, which may be readily monitored [see Shone C. (1987) Eur. J. Biochem; vol. 167(1): pp. 175-180].

A further example is provided by Blaustein R. (1987), which describes a simple in vitro assay employing planar phospholipid bilayer membranes. The membranes are challenged with a test molecule and the requisite translocation function is confirmed by an increase in conductance across said membranes [see Blaustein (1987) FEBS Letts; vol. 226, no. 1: pp. 115-120].

Additional methodology to enable assessment of membrane fusion and thus identification of Translocation Domains suitable for use in the present invention are provided by Methods in Enzymology Vol 220 and 221, Membrane Fusion Techniques, Parts A and B, Academic Press 1993.

The present invention also embraces variant translocation domains, so long as the variant domains still demonstrate the requisite translocation activity. By way of example, a variant may have at least 70%, preferably at least 80%, more preferably at least 90%, and most preferably at least 95% or at least 98% amino acid sequence homology with a reference translocation domain. The term fragment, when used in relation to a translocation domain, means a peptide having at least 20, preferably at least 40, more preferably at least 80, and most preferably at least 100 amino acid residues of the reference translocation domain. In the case of a clostridial translocation domain, the fragment preferably has at least 100, preferably at least 150, more preferably at least 200, and most preferably at least 250 amino acid residues of the reference translocation domain (eg. $H_N$ domain). As with the TM 'fragment' component (discussed above), translocation 'fragments' of the present invention embrace fragments of variant translocation domains based on the reference sequences.

The Translocation Domain is preferably capable of formation of ion-permeable pores in lipid membranes under conditions of low pH. Preferably it has been found to use only those portions of the protein molecule capable of pore-formation within the endosomal membrane.

The Translocation Domain may be obtained from a microbial protein source, in particular from a bacterial or viral protein source. Hence, in one embodiment, the Translocation Domain is a translocating domain of an enzyme, such as a bacterial toxin or viral protein.

It is well documented that certain domains of bacterial toxin molecules are capable of forming such pores. It is also known that certain translocation domains of virally expressed membrane fusion proteins are capable of forming such pores. Such domains may be employed in the present invention.

The Translocation Domain may be of a clostridial origin, such as the $H_N$ domain (or a functional component thereof). $H_N$ means a portion or fragment of the H-chain of a clostridial neurotoxin approximately equivalent to the amino-terminal half of the H-chain, or the domain corresponding to that fragment in the intact H-chain. The H-chain lacks the natural binding function of the $H_C$ component of the H-chain. In this regard, the $H_C$ function may be removed by deletion of the $H_C$ amino acid sequence (either at the DNA synthesis level, or at the post-synthesis level by nuclease or protease treatment). Alternatively, the $H_C$ function may be inactivated by chemical or biological treatment. Thus, the H-chain is incapable of binding to the Binding Site on a target cell to which native clostridial neurotoxin (i.e. holotoxin) binds.

Examples of suitable (reference) Translocation Domains include:

Botulinum type A neurotoxin—amino acid residues (449-871)

Botulinum type B neurotoxin—amino acid residues (441-858)

Botulinum type C neurotoxin—amino acid residues (442-866)

Botulinum type D neurotoxin—amino acid residues (446-862)

Botulinum type E neurotoxin—amino acid residues (423-845)

Botulinum type F neurotoxin—amino acid residues (440-864)

Botulinum type G neurotoxin—amino acid residues (442-863)

Tetanus neurotoxin—amino acid residues (458-879)

The above-identified reference sequence should be considered a guide as slight variations may occur according to sub-serotypes. By way of example, US 2007/0166332 (hereby incorporated by reference thereto) cites slightly different clostridial sequences:

Botulinum type A neurotoxin—amino acid residues (A449-K871)

Botulinum type B neurotoxin—amino acid residues (A442-5858)

Botulinum type C neurotoxin—amino acid residues (T450-N866)

Botulinum type D neurotoxin—amino acid residues (D446-N862)

Botulinum type E neurotoxin—amino acid residues (K423-K845)

Botulinum type F neurotoxin—amino acid residues (A440-K864)

Botulinum type G neurotoxin—amino acid residues (S447-S863)

Tetanus neurotoxin—amino acid residues (S458-V879)

In the context of the present invention, a variety of Clostridial toxin $H_N$ regions comprising a translocation domain can be useful in aspects of the present invention with the proviso that these active fragments can facilitate the release of a non-cytotoxic protease (e.g. a clostridial L-chain) from intracellular vesicles into the cytoplasm of the target cell and thus participate in executing the overall cellular mechanism whereby a clostridial toxin proteolytically cleaves a substrate. The $H_N$ regions from the heavy chains of Clostridial toxins are approximately 410-430 amino acids in length and comprise a translocation domain. Research has shown that the entire length of a $H_N$ region from a Clostridial toxin heavy chain is not necessary for the translocating activity of the translocation domain. Thus, aspects of this embodiment can include clostridial toxin $H_N$ regions comprising a translocation domain having a length of, for example, at least 350 amino acids, at least 375 amino acids, at least 400 amino acids and at least 425 amino acids. Other aspects of this embodiment can include clostridial toxin $H_N$ regions comprising translocation domain having a length of, for example, at most 350 amino acids, at most 375 amino acids, at most 400 amino acids and at most 425 amino acids.

For further details on the genetic basis of toxin production in *Clostridium botulinum* and *C. tetani*, we refer to Henderson et al (1997) in *The Clostridia: Molecular Biology and Pathogenesis*, Academic press.

The term $H_N$ embraces naturally-occurring neurotoxin $H_N$ portions, and modified $H_N$ portions having amino acid sequences that do not occur in nature and/or synthetic amino acid residues, so long as the modified $H_N$ portions still demonstrate the above-mentioned translocation function.

Alternatively, the Translocation Domain may be of a non-clostridial origin. Examples of non-clostridial (reference) Translocation Domain origins include, but not be restricted to, the translocation domain of diphtheria toxin [O=Keefe et al., Proc. Natl. Acad. Sci. USA (1992) 89, 6202-6206; Silverman et al., J. Biol. Chem. (1993) 269, 22524-22532; and London, E. (1992) *Biochem. Biophys. Acta.,* 1112, pp. 25-51], the translocation domain of *Pseudomonas* exotoxin type A [Prior et al. Biochemistry (1992) 31, 3555-3559], the translocation domains of anthrax toxin [Blanke et al. Proc. Natl. Acad. Sci. USA (1996) 93, 8437-8442], a variety of fusogenic or hydrophobic peptides of translocating function [Plank et al. J. Biol. Chem. (1994) 269, 12918-12924; and Wagner et al (1992) *PNAS,* 89, pp. 7934-7938], and amphiphilic peptides [Murata et al (1992) *Biochem.,* 31, pp. 1986-1992]. The Translocation Domain may mirror the Translocation Domain present in a naturally-occurring protein, or may include amino acid variations so long as the variations do not destroy the translocating ability of the Translocation Domain.

Particular examples of viral (reference) Translocation Domains suitable for use in the present invention include certain translocating domains of virally expressed membrane fusion proteins. For example, Wagner et al. (1992) and Murata et al. (1992) describe the translocation (i.e. membrane fusion and vesiculation) function of a number of fusogenic and amphiphilic peptides derived from the N-terminal region of influenza virus haemagglutinin. Other virally expressed membrane fusion proteins known to have the desired translocating activity are a translocating domain of a fusogenic peptide of Semliki Forest Virus (SFV), a translocating domain of vesicular stomatitis virus (VSV) glycoprotein G, a translocating domain of SER virus F protein and a translocating domain of Foamy virus envelope glycoprotein. Virally encoded Aspike proteins have particular application in the context of the present invention, for example, the E1 protein of SFV and the G protein of the G protein of VSV.

Use of the (reference) Translocation Domains listed in Table (below) includes use of sequence variants thereof. A variant may comprise one or more conservative nucleic acid substitutions and/or nucleic acid deletions or insertions, with the proviso that the variant possesses the requisite translocating function. A variant may also comprise one or more amino acid substitutions and/or amino acid deletions or insertions, so long as the variant possesses the requisite translocating function.

| Translocation Domain source | Amino acid residues | References |
|---|---|---|
| Diphtheria toxin | 194-380 | Silverman et al., 1994, J. Biol. Chem. 269, 22524-22532 London E., 1992, Biochem. Biophys. Acta., 1113, 25-51 |
| Domain II of pseudomonas exotoxin | 405-613 | Prior et al., 1992, Biochemistry 31, 3555-3559 Kihara & Pastan, 1994, Bioconj Chem. 5, 532-538 |
| Influenza virus haemagglutinin | GLFGAIAGFIENGW EGMIDGWYG (SEQ ID NO: 117), and Variants thereof | Plank et al., 1994, J. Biol. Chem. 269, 12918-12924 Wagner et al., 1992, PNAS, 89, 7934-7938 Murata et al., 1992, Biochemistry 31, 1986-1992 |
| Semliki Forest virus fusogenic protein | Translocation domain | Kielian et al., 1996, J Cell Biol. 134(4), 863-872 |
| Vesicular Stomatitis virus glycoprotein G | 118-139 | Yao et al., 2003, Virology 310(2), 319-332 |
| SER virus F protein | Translocation domain | Seth et al., 2003, J Virol 77(11) 6520-6527 |
| Foamy virus envelope glycoprotein | Translocation domain | Picard-Maureau et al., 2003, J Virol. 77(8), 4722-4730 |

The polypeptides of the present invention may further comprise a translocation facilitating domain. Said domain facilitates delivery of the non-cytotoxic protease into the cytosol of the target cell and are described, for example, in WO 08/008,803 and WO 08/008,805, each of which is herein incorporated by reference thereto.

By way of example, suitable translocation facilitating domains include an enveloped virus fusogenic peptide domain, for example, suitable fusogenic peptide domains include influenzavirus fusogenic peptide domain (eg. influenza A virus fusogenic peptide domain of 23 amino acids), alphavirus fusogenic peptide domain (eg. Semliki Forest virus fusogenic peptide domain of 26 amino acids), vesiculovirus fusogenic peptide domain (eg. vesicular stomatitis virus fusogenic peptide domain of 21 amino acids), respirovirus fusogenic peptide domain (eg. Sendai virus fusogenic peptide domain of 25 amino acids), morbiliivirus fusogenic peptide domain (eg. Canine distemper virus fusogenic peptide domain of 25 amino acids), avulavirus fusogenic peptide domain (eg. Newcastle disease virus fusogenic peptide domain of 25 amino acids), henipavirus fusogenic peptide domain (eg. Hendra virus fusogenic peptide domain of 25 amino acids), metapneumovirus fusogenic peptide domain (eg. Human metapneumovirus fusogenic peptide domain of 25 amino acids) or spumavirus fusogenic peptide domain such as simian foamy virus fusogenic peptide domain; or fragments or variants thereof.

By way of further example, a translocation facilitating domain may comprise a Clostridial toxin $H_{CN}$ domain or a fragment or variant thereof. In more detail, a Clostridial toxin $H_{CN}$ translocation facilitating domain may have a length of at least 200 amino acids, at least 225 amino acids, at least 250 amino acids, at least 275 amino acids. In this regard, a Clostridial toxin $H_{CN}$ translocation facilitating domain preferably has a length of at most 200 amino acids, at most 225 amino acids, at most 250 amino acids, or at most 275 amino acids. Specific (reference) examples include:

Botulinum type A neurotoxin—amino acid residues (872-1110)

Botulinum type B neurotoxin—amino acid residues (859-1097)

Botulinum type C neurotoxin—amino acid residues (867-1111)

Botulinum type D neurotoxin—amino acid residues (863-1098)

Botulinum type E neurotoxin—amino acid residues (846-1085)

Botulinum type F neurotoxin—amino acid residues (865-1105)

Botulinum type G neurotoxin—amino acid residues (864-1105)

Tetanus neurotoxin—amino acid residues (880-1127)

The above sequence positions may vary a little according to serotype/sub-type, and further examples of suitable (reference) Clostridial toxin $H_{CN}$ domains include:

Botulinum type A neurotoxin—amino acid residues (874-1110)

Botulinum type B neurotoxin—amino acid residues (861-1097)

Botulinum type C neurotoxin—amino acid residues (869-1111)

Botulinum type D neurotoxin—amino acid residues (865-1098)

Botulinum type E neurotoxin—amino acid residues (848-1085)

Botulinum type F neurotoxin—amino acid residues (867-1105)

Botulinum type G neurotoxin—amino acid residues (866-1105)

Tetanus neurotoxin—amino acid residues (882-1127)

Any of the above-described facilitating domains may be combined with any of the previously described translocation domain peptides that are suitable for use in the present invention. Thus, by way of example, a non-clostridial facilitating domain may be combined with non-clostridial translocation domain peptide or with clostridial translocation domain peptide. Alternatively, a Clostridial toxin $H_{CN}$ translocation facilitating domain may be combined with a non-clostridal translocation domain peptide. Alternatively, a Clostridial toxin $H_{CN}$ facilitating domain may be combined or with a clostridial translocation domain peptide, examples of which include:

Botulinum type A neurotoxin—amino acid residues (449-1110)

Botulinum type B neurotoxin—amino acid residues (442-1097)

Botulinum type C neurotoxin—amino acid residues (450-1111)

Botulinum type D neurotoxin—amino acid residues (446-1098)

Botulinum type E neurotoxin—amino acid residues (423-1085)

Botulinum type F neurotoxin—amino acid residues (440-1105)

Botulinum type G neurotoxin—amino acid residues (447-1105)

Tetanus neurotoxin—amino acid residues (458-1127)

Sequence Homology:

Any of a variety of sequence alignment methods can be used to determine percent identity, including, without limitation, global methods, local methods and hybrid methods, such as, e.g., segment approach methods. Protocols to determine percent identity are routine procedures within the scope of one skilled in the art. Global methods align sequences from the beginning to the end of the molecule and determine the best alignment by adding up scores of individual residue pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position-Specific Gap Penalties and Weight Matrix Choice, 22(22) Nucleic Acids Research 4673-4680 (1994); and iterative refinement, see, e.g., Osamu Gotoh, Significant Improvement in Accuracy of Multiple Protein. Sequence Alignments by Iterative Refinement as Assessed by Reference to Structural Alignments, 264(4) J. Mol. Biol. 823-838 (1996). Local methods align sequences by identifying one or more conserved motifs shared by all of the input sequences. Non-limiting methods include, e.g., Match-box, see, e.g., Eric Depiereux and Ernest Feytmans, Match-Box: A Fundamentally New Algorithm for the Simultaneous Alignment of Several Protein Sequences, 8(5) CABIOS 501-509 (1992); Gibbs sampling, see, e.g., C. E. Lawrence et al., Detecting Subtle Sequence Signals: A Gibbs Sampling Strategy for Multiple Alignment, 262(5131) Science 208-214 (1993); Align-M, see, e.g., Ivo Van Wane et al., Align-M—A New Algorithm for Multiple Alignment of Highly Divergent Sequences, 20(9) Bioinformatics: 1428-1435 (2004).

Thus, percent sequence identity is determined by conventional methods. See, for example, Altschul et al., *Bull. Math. Bio.* 48: 603-16, 1986 and Henikoff and Henikoff, *Proc. Natl. Acad. Sci. USA* 89:10915-19, 1992. Briefly, two amino acid sequences are aligned to optimize the alignment scores using a gap opening penalty of 10, a gap extension penalty of 1, and the "blosum 62" scoring matrix of Henikoff and Henikoff (ibid.) as shown below (amino acids are indicated by the standard one-letter codes).

Alignment Scores for Determining Sequence Identity

| | A | R | N | D | C | Q | E | G | H | I | L | K | M | F | P | S | T | W | Y | V |
|---|---|---|---|---|---|---|---|---|---|---|---|---|---|---|---|---|---|---|---|---|
| A | 4 | | | | | | | | | | | | | | | | | | | |
| R | −1 | 5 | | | | | | | | | | | | | | | | | | |
| N | −2 | 0 | 6 | | | | | | | | | | | | | | | | | |
| D | −2 | −2 | 1 | 6 | | | | | | | | | | | | | | | | |
| C | 0 | −3 | −3 | −3 | 9 | | | | | | | | | | | | | | | |
| Q | −1 | 1 | 0 | 0 | −3 | 5 | | | | | | | | | | | | | | |
| E | −1 | 0 | 0 | 2 | −4 | 2 | 5 | | | | | | | | | | | | | |
| G | 0 | −2 | 0 | −1 | −3 | −2 | −2 | 6 | | | | | | | | | | | | |
| H | −2 | 0 | 1 | −1 | −3 | 0 | 0 | −2 | 8 | | | | | | | | | | | |

-continued

| | A | R | N | D | C | Q | E | G | H | I | L | K | M | F | P | S | T | W | Y | V |
|---|---|---|---|---|---|---|---|---|---|---|---|---|---|---|---|---|---|---|---|---|
| I | −1 | −3 | −3 | −3 | −1 | −3 | −3 | −4 | −3 | 4 | | | | | | | | | | |
| L | −1 | −2 | −3 | −4 | −1 | −2 | −3 | −4 | −3 | 2 | 4 | | | | | | | | | |
| K | −1 | 2 | 0 | −1 | −3 | 1 | 1 | −2 | −1 | −3 | −2 | 5 | | | | | | | | |
| M | −1 | −1 | −2 | −3 | −1 | 0 | −2 | −3 | −2 | 1 | 2 | −1 | 5 | | | | | | | |
| F | −2 | −3 | −3 | −3 | −2 | −3 | −3 | −3 | −1 | 0 | 0 | −3 | 0 | 6 | | | | | | |
| P | −1 | −2 | −2 | −1 | −3 | −1 | −1 | −2 | −2 | −3 | −3 | −1 | −2 | −4 | 7 | | | | | |
| S | 1 | −1 | 1 | 0 | −1 | 0 | 0 | 0 | −1 | −2 | −2 | 0 | −1 | −2 | −1 | 4 | | | | |
| T | 0 | −1 | 0 | −1 | −1 | −1 | −1 | −2 | −2 | −1 | −1 | −1 | −1 | −2 | −1 | 1 | 5 | | | |
| W | −3 | −3 | −4 | −4 | −2 | −2 | −3 | −2 | −2 | −3 | −2 | −3 | −1 | 1 | −4 | −3 | −2 | 11 | | |
| Y | −2 | −2 | −2 | −3 | −2 | −1 | −2 | −3 | 2 | −1 | −1 | −2 | −1 | 3 | −3 | −2 | −2 | 2 | 7 | |
| V | 0 | −3 | −3 | −3 | −1 | −2 | −2 | −3 | −3 | 3 | 1 | −2 | 1 | −1 | −2 | −2 | 0 | −3 | −1 | 4 |

The percent identity is then calculated as:

$$\frac{\text{(Total number of identical matches)}}{\text{[length of the longer sequence plus the number of gaps introduced into the longer sequence in order to align the two sequences]}} \times 100$$

Substantially homologous polypeptides are characterized as having one or more amino acid substitutions, deletions or additions. These changes are preferably of a minor nature, that is conservative amino acid substitutions (see below) and other substitutions that do not significantly affect the folding or activity of the polypeptide; small deletions, typically of one to about 30 amino acids; and small amino- or carboxyl-terminal extensions, such as an amino-terminal methionine residue, a small linker peptide of up to about 20-25 residues, or an affinity tag.

Conservative Amino Acid Substitutions

| | |
|---|---|
| Basic: | arginine<br>lysine<br>histidine |
| Acidic: | glutamic acid<br>aspartic acid |
| Polar: | glutamine<br>asparagine |
| Hydrophobic: | leucine<br>isoleucine<br>valine |
| Aromatic: | phenylalanine<br>tryptophan<br>tyrosine |
| Small: | glycine<br>alanine<br>serine<br>threonine<br>methionine |

In addition to the 20 standard amino acids, non-standard amino acids (such as 4-hydroxyproline, 6-N-methyl lysine, 2-aminoisobutyric acid, isovaline and α-methyl serine) may be substituted for amino acid residues of the polypeptides of the present invention. A limited number of non-conservative amino acids, amino acids that are not encoded by the genetic code, and unnatural amino acids may be substituted for clostridial polypeptide amino acid residues. The polypeptides of the present invention can also comprise non-naturally occurring amino acid residues.

Non-naturally occurring amino acids include, without limitation, trans-3-methylproline, 2,4-methano-proline, cis-4-hydroxyproline, trans-4-hydroxyproline, N-methylglycine, allo-threonine, methyl-threonine, hydroxy-ethylcysteine, hydroxyethylhomo-cysteine, nitro-glutamine, homoglutamine, pipecolic acid, tert-leucine, norvaline, 2-azaphenylalanine, 3-azaphenyl-alanine, 4-azaphenyl-alanine, and 4-fluorophenylalanine. Several methods are known in the art for incorporating non-naturally occurring amino acid residues into proteins. For example, an in vitro system can be employed wherein nonsense mutations are suppressed using chemically aminoacylated suppressor tRNAs. Methods for synthesizing amino acids and aminoacylating tRNA are known in the art. Transcription and translation of plasmids containing nonsense mutations is carried out in a cell free system comprising an *E. coli* S30 extract and commercially available enzymes and other reagents. Proteins are purified by chromatography. See, for example, Robertson et al., *J. Am. Chem. Soc.* 113:2722, 1991; Ellman et al., *Methods Enzymol.* 202:301, 1991; Chung et al., *Science* 259:806-9, 1993; and Chung et al., *Proc. Natl. Acad. Sci. USA* 90:10145-9, 1993). In a second method, translation is carried out in *Xenopus* oocytes by microinjection of mutated mRNA and chemically aminoacylated suppressor tRNAs (Turcatti et al., *J. Biol. Chem.* 271:19991-8, 1996). Within a third method, *E. coli* cells are cultured in the absence of a natural amino acid that is to be replaced (e.g., phenylalanine) and in the presence of the desired non-naturally occurring amino acid(s) (e.g., 2-azaphenylalanine, 3-azaphenylalanine, 4-azaphenylalanine, or 4-fluorophenylalanine). The non-naturally occurring amino acid is incorporated into the polypeptide in place of its natural counterpart. See, Koide et al., *Biochem.* 33:7470-6, 1994. Naturally occurring amino acid residues can be converted to non-naturally occurring species by in vitro chemical modification. Chemical modification can be combined with site-directed mutagenesis to further expand the range of substitutions (Wynn and Richards, *Protein Sci.* 2:395-403, 1993).

A limited number of non-conservative amino acids, amino acids that are not encoded by the genetic code, non-naturally occurring amino acids, and unnatural amino acids may be substituted for amino acid residues of polypeptides of the present invention.

Essential amino acids in the polypeptides of the present invention can be identified according to procedures known in the art, such as site-directed mutagenesis or alanine-scanning mutagenesis (Cunningham and Wells, *Science* 244:1081-5, 1989). Sites of biological interaction can also be determined by physical analysis of structure, as determined by such techniques as nuclear magnetic resonance, crystallography, electron diffraction or photoaffinity labeling, in conjunction with mutation of putative contact site amino acids. See, for example, de Vos et al., *Science* 255:306-12, 1992; Smith et al., *J. Mol. Biol.* 224:899-904, 1992; Wlodaver et al., *FEBS Lett.* 309:59-64, 1992. The identities of essential amino acids can also be inferred from analysis of homologies with related components (e.g. the translocation or protease components) of the polypeptides of the present invention.

Multiple amino acid substitutions can be made and tested using known methods of mutagenesis and screening, such as those disclosed by Reidhaar-Olson and Sauer (*Science* 241: 53-7, 1988) or Bowie and Sauer (*Proc. Natl. Acad. Sci. USA* 86:2152-6, 1989). Briefly, these authors disclose methods for simultaneously randomizing two or more positions in a polypeptide, selecting for functional polypeptide, and then sequencing the mutagenized polypeptides to determine the spectrum of allowable substitutions at each position. Other methods that can be used include phage display (e.g., Lowman et al., *Biochem.* 30:10832-7, 1991; Ladner et al., U.S. Pat. No. 5,223,409; Huse, WIPO Publication WO 92/06204) and region-directed mutagenesis (Derbyshire et al., *Gene* 46:145, 1986; Ner et al., *DNA* 7:127, 1988).

Multiple amino acid substitutions can be made and tested using known methods of mutagenesis and screening, such as those disclosed by Reidhaar-Olson and Sauer (*Science* 241: 53-7, 1988) or Bowie and Sauer (*Proc. Natl. Acad. Sci. USA* 86:2152-6, 1989). Briefly, these authors disclose methods for simultaneously randomizing two or more positions in a polypeptide, selecting for functional polypeptide, and then sequencing the mutagenized polypeptides to determine the spectrum of allowable substitutions at each position. Other methods that can be used include phage display (e.g., Lowman et al., *Biochem.* 30:10832-7, 1991; Ladner et al., U.S. Pat. No. 5,223,409; Huse, WIPO Publication WO 92/06204) and region-directed mutagenesis (Derbyshire et al., *Gene* 46:145, 1986; Ner et al., *DNA* 7:127, 1988).

There now follows a brief description of the Figures, which illustrate aspects and/or embodiments of the present invention.

FIG. 1—Purification of a $LH_N$/C-Rat GHRP Fusion Protein

Using the methodology outlined in Example 3, a $LH_N$/C-rGHRP fusion protein (SEQ ID NO: 8) was purified from *E. coli* BL21 (DE3) cells. Briefly, the soluble products obtained following cell disruption were applied to a nickel-charged affinity capture column. Bound proteins were eluted with 200 mM imidazole, treated with Factor Xa to activate the fusion protein and then re-applied to a second nickel-charged affinity capture column. Samples from the purification procedure were assessed by SDS-PAGE. Lane 1: Molecular mass markers (kDa), lane 2: Clarified crude cell lysate, lanes 3-5: First nickel chelating Sepharose column eluant (0.1 mg/ml), lanes 6-8: First nickel chelating Sepharose column eluant (0.01 mg/ml), lane 9: Factor Xa digested protein under non-reducing conditions, lane 10: Purified $LH_N$/C-rGHRP (SEQ ID NO: 8) under non-reducing conditions, lane 11: Purified $LH_N$/C-rGHRP (SEQ ID NO: 8) under reduced conditions.

Figure 2:
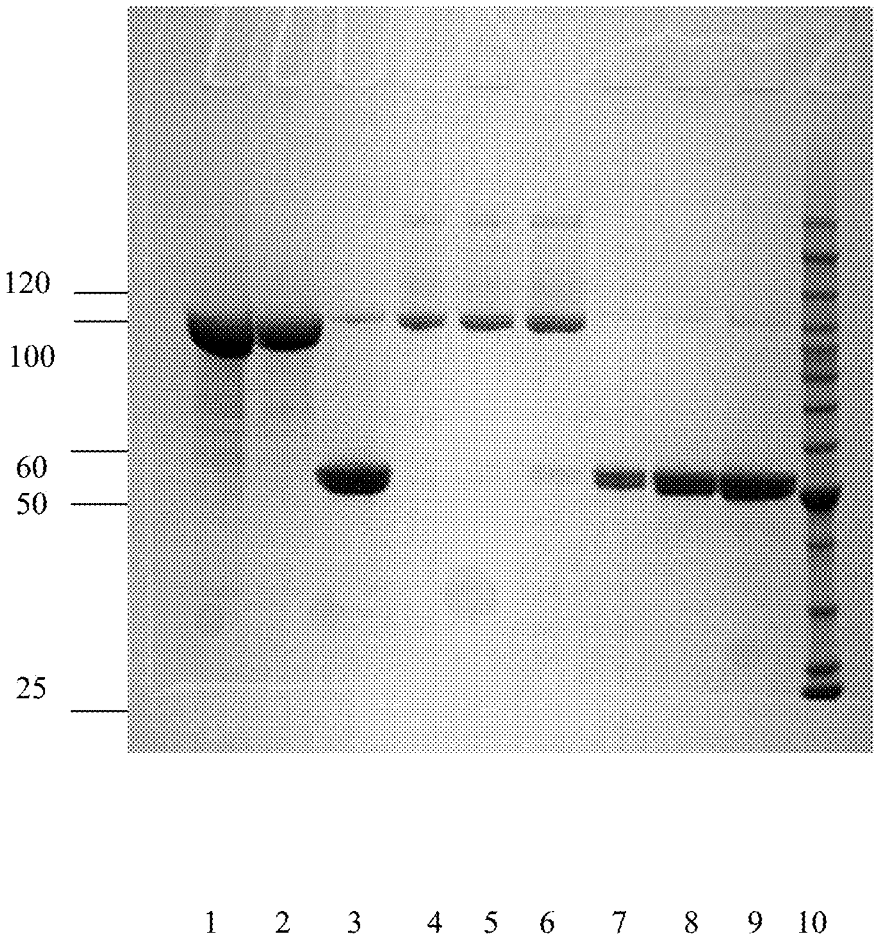

FIG. 2—Purification of $LH_N$/C-Rat LEP116-122 Fusion Protein

Figure 3:
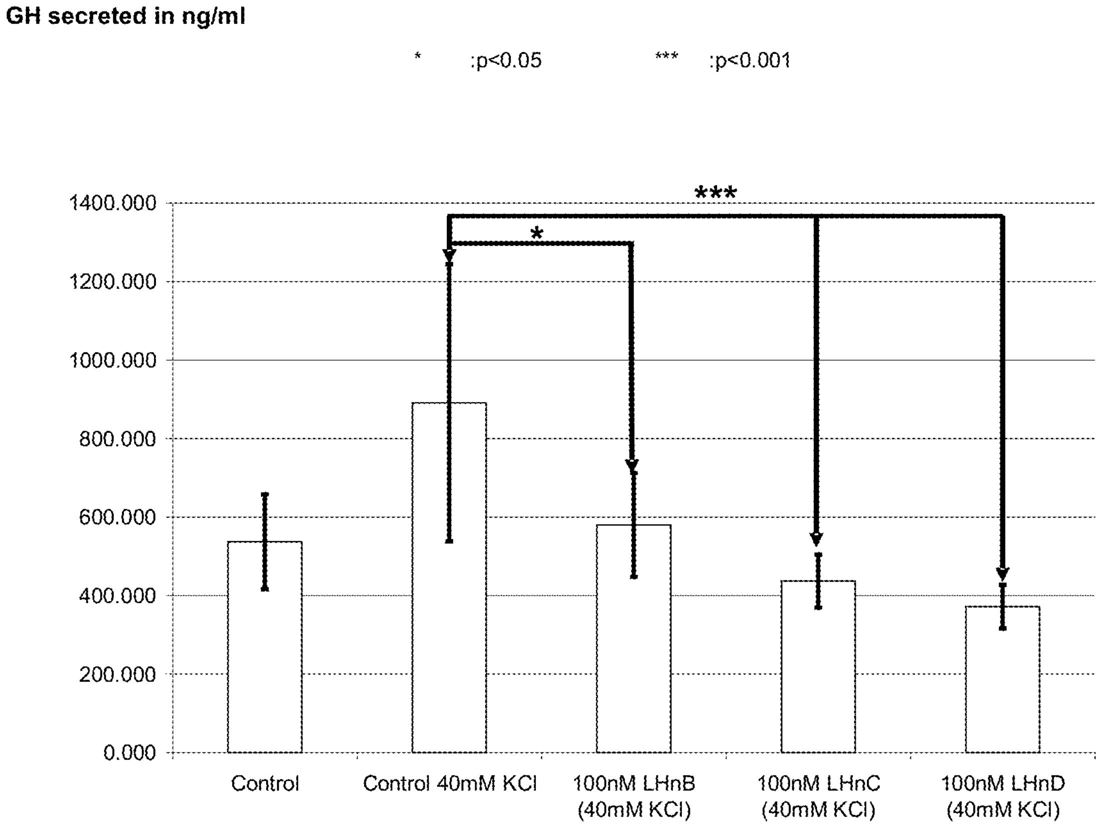

Using the methodology outlined in Example 3, a $LH_N$/C-Rat LEP116-122 (SEQ ID NO. 14) fusion protein was purified from *E. coli* BL21 (DE3) cells. Briefly, the soluble products obtained following cell disruption were applied to a nickel-charged affinity capture column. Bound proteins were eluted with 200 mM imidazole, treated with Factor Xa to activate the fusion protein and then re-applied to a second nickel-charged affinity capture column. Samples from the purification procedure were assessed by SDS-PAGE. Lane 1: First nickel chelating Sepharose column eluant, Lane 2: First nickel chelating Sepharose column eluant treated with Factor Xa under non-reducing conditions, Lane 3: First nickel chelating Sepharose column eluant treated with Factor Xa under reducing conditions, lanes 4-6: Second nickel chelating Sepharose column eluant under non-reducing conditions, lane 7-9: Second nickel chelating Sepharose column eluant under reducing conditions, lane 10: Molecular mass markers (kDa), FIG. 3—GH Secretion from Differentiated MtT/S Treated with Various LHn Using the methodology outlined in the experimental data section: after differentiation of the MtT/S cells with 10-8M corticosterone the cells were treated during 48 h with one of the following molecule: $LH_N$/B (100 nM) (SEQ ID NO: 46), $LH_N$/C (100 nM) (SEQ ID NO: 47) or $LH_N$/D (100 nM) (SEQ ID NO: 48). The cells were then submitted to a secretion assay using Krebs Medium containing 40 mM KCl for 10 minutes.

Figure 4:
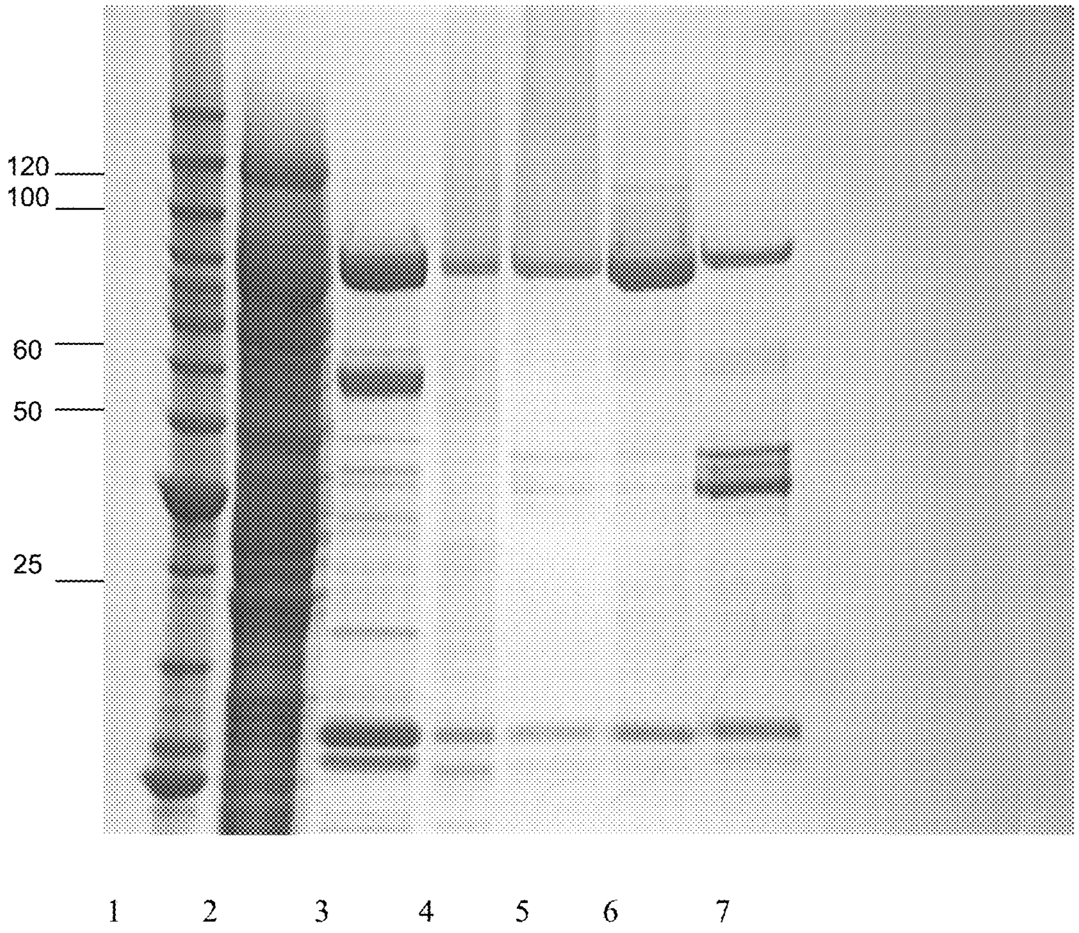

FIG. 4—Purification of $LH_N$/A-GHRH Fusion Protein

Using the methodology outlined in Example 3, a $LH_N$/A-GHRH fusion protein, formed by the fusion of $LH_N$/A (SEQ ID NO: 45) and GHRH (SEQ ID NO: 151), was purified from *E. coli* BL21 (DE3) cells. Briefly, the soluble products obtained following cell disruption were applied to a nickel-charged affinity capture column. Bound proteins were eluted with 200 mM imidazole, treated with Factor Xa to activate the fusion protein and then re-applied to a second nickel-charged affinity capture column. Samples from the purification procedure were assessed by SDS-PAGE Lane 1: Molecular mass markers (kDa), Lane 2: Soluble Fraction, Lane 3: First nickel chelating Sepharose column eluant treated with Factor Xa under non-reducing conditions, Lane 4: Second nickel chelating Sepharose column load under non-reducing conditions, Lane 5: Second nickel chelating Sepharose column eluant under non-reducing conditions, Lane 6: Final sample under non reducing conditions Lane 7: Final sample under reducing condition.

Figure 5:
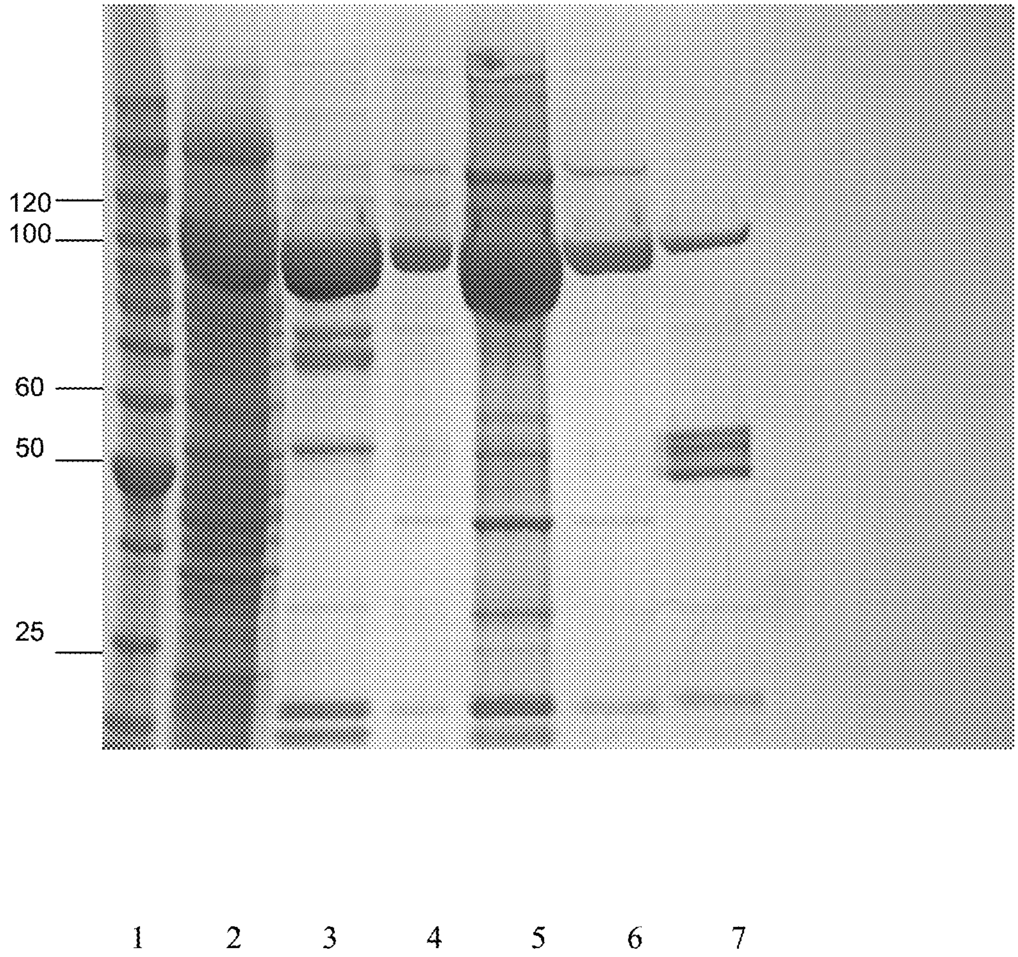

FIG. 5—Purification of $LH_N$/C-GHRH Fusion Protein.

Using the methodology outlined in Example 3, a $LH_N$/C-GHRH fusion protein, formed by the fusion of $LH_N$/C (SEQ ID NO: 47) and GHRH (SEQ ID NO: 151) was purified from *E. coli* BL21 (DE3) cells. Briefly, the soluble products obtained following cell disruption were applied to a nickel-charged affinity capture column. Bound proteins were eluted with 200 mM imidazole, treated with Factor Xa to activate the fusion protein and then re-applied to a second nickel-charged affinity capture column. Samples from the purification procedure were assessed by SDS-PAGE. Lane 1: Molecular mass markers (kDa), Lane 2: Soluble fraction, Lane 3: First nickel chelating Sepharose column eluant treated with Factor Xa under non-reducing conditions, Lane 4: Second nickel chelating Sepharose column load under non-reducing conditions, Lane 5: Second nickel chelating Sepharose column eluant under non-reducing conditions, Lane 6: Final sample under non reducing conditions Lane 7: Final sample under reducing condition.

Figure 6:
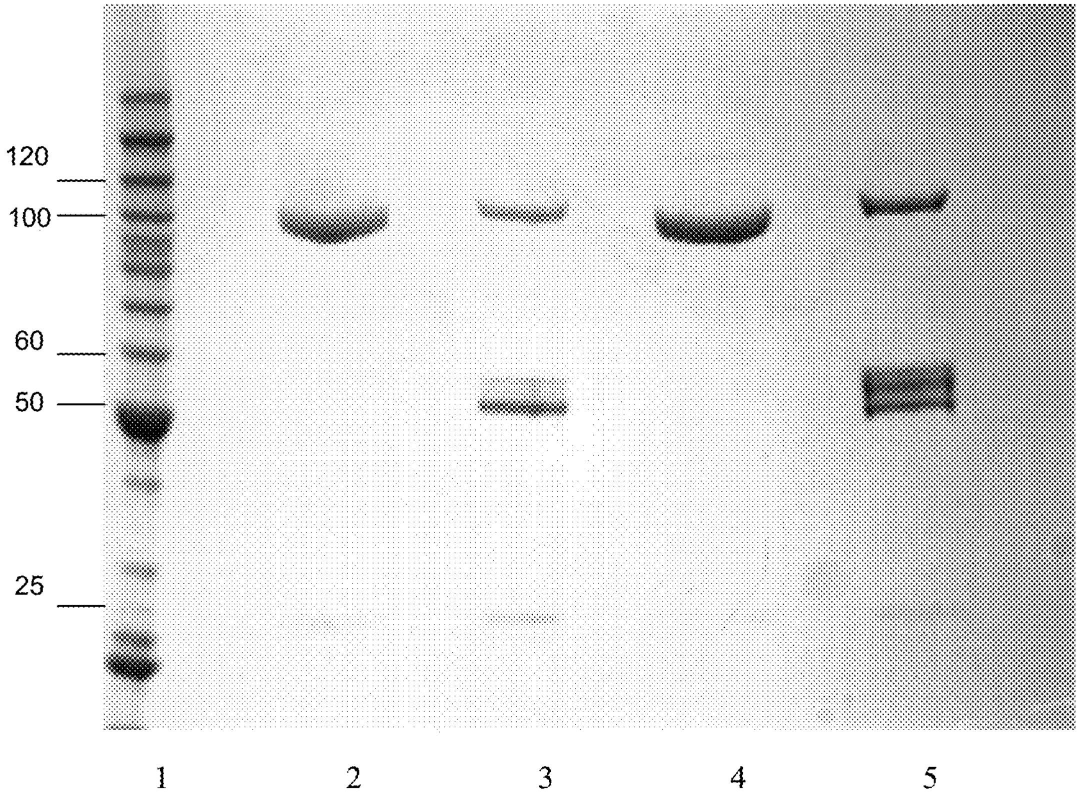

FIG. 6—$LH_N$/A-GHRH and $LH_N$/C-GHRH Final Product.

Using the methodology outlined in Example 3, $LH_N$/A-GHRH (formed by the fusion of $LH_N$/A (SEQ ID NO: 45) and (SEQ ID NO:151)) and $LH_N$/C-GHRH (formed by the fusion of $LH_N$/C (SEQ ID NO: 47) and GHRH (SEQ ID NO: 151)), Fusion proteins were purified from *E. coli* BL21 (DE3) cells. Samples From die purification procedure were assessed by SDS-PAGE. Lane 1: Molecular mass markers (kDa), Lane 2: Final sample ($LH_N$/A-GHRH) under non reducing conditions, Lane 3: Final sample ($LH_N$/A-GHRH) under reducing condition, Lane 4: Final sample ($LH_N$/C-

GHRH) under non-reducing conditions, Lane 5: Final sample ($LH_N$/C-GHRH) under reducing condition.

Figure 7:
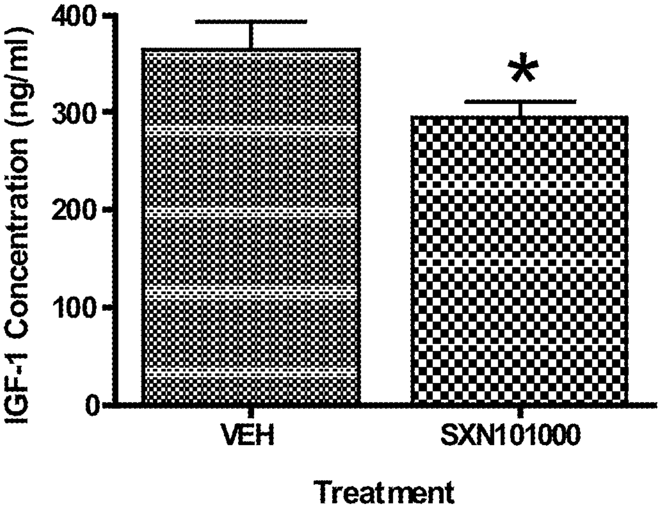

FIG. 7—Activity of CP-GHRH-LHD on Rat IGF-1 Levels In Vivo

FIG. 7 shows the effects of i.v. administration of CP-GHRH-LHD (SXN101000) (SEQ ID NO: 36) on rat IGF-1 levels 5 days after treatment compared to a vehicle only control.

Figure 8:
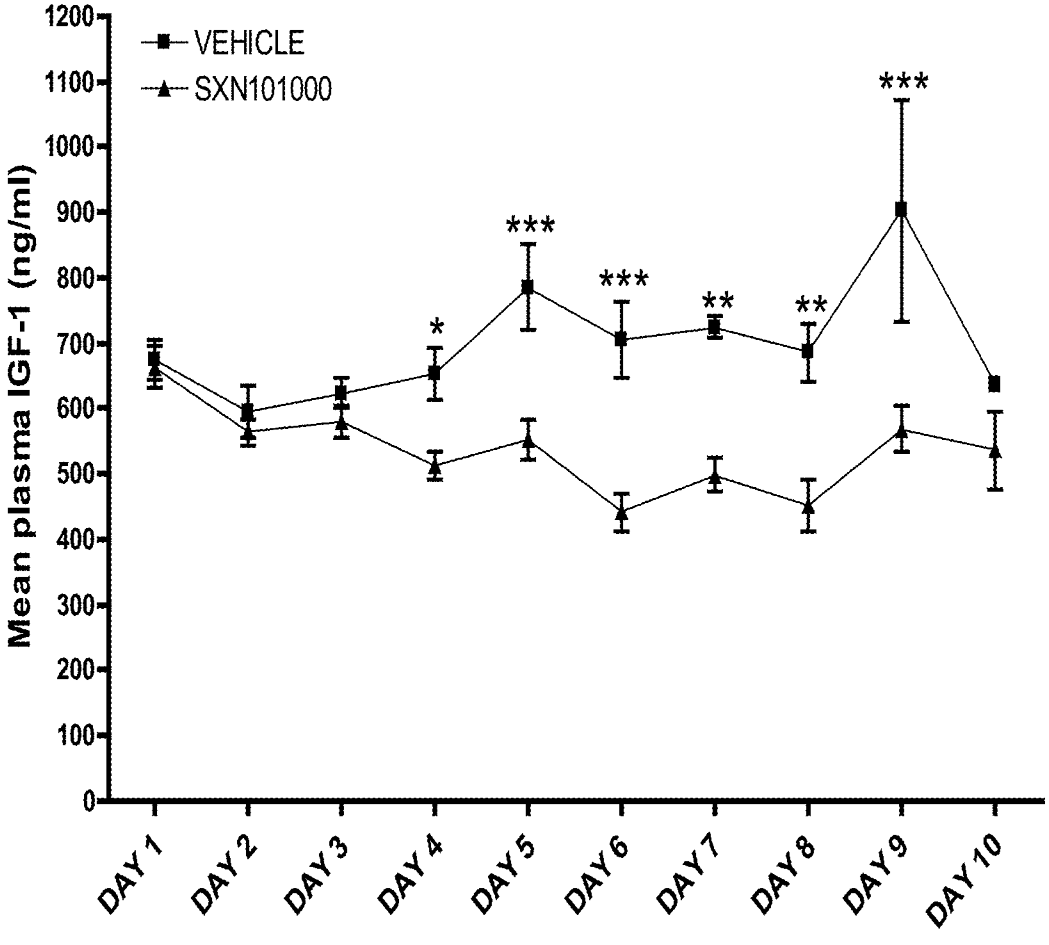

FIG. 8—Activity of CP-GHRH-LHD on Rat IGF-1 Levels In Vivo

FIG. 8 shows the effects of i.v. administration of CP-GHRH-LHD (SXN101000) (SEQ ID NO: 36) on rat IGF-1 levels on day 1 to 8 days after treatment compared to a vehicle only control. Due to the blocking of the cannula on days 9 and 10 have too few an n number to be considered.

FIG. 9—Activity of CP-GHRH-LHD on Rat GH Levels In Vivo

Figure 9A:
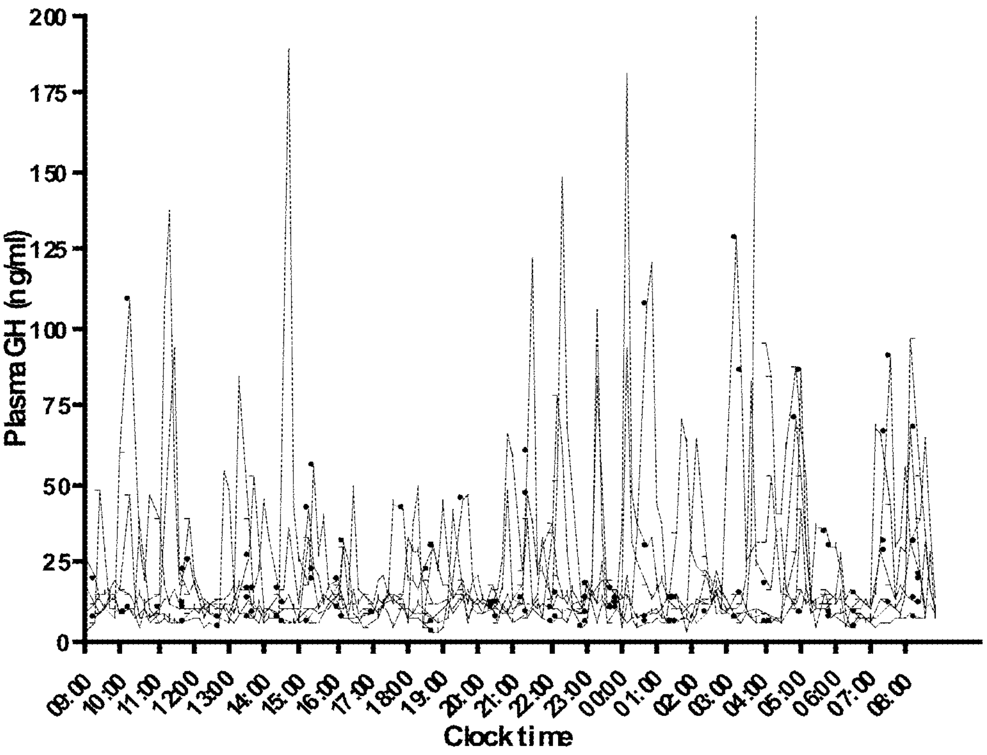
Figure 9B:
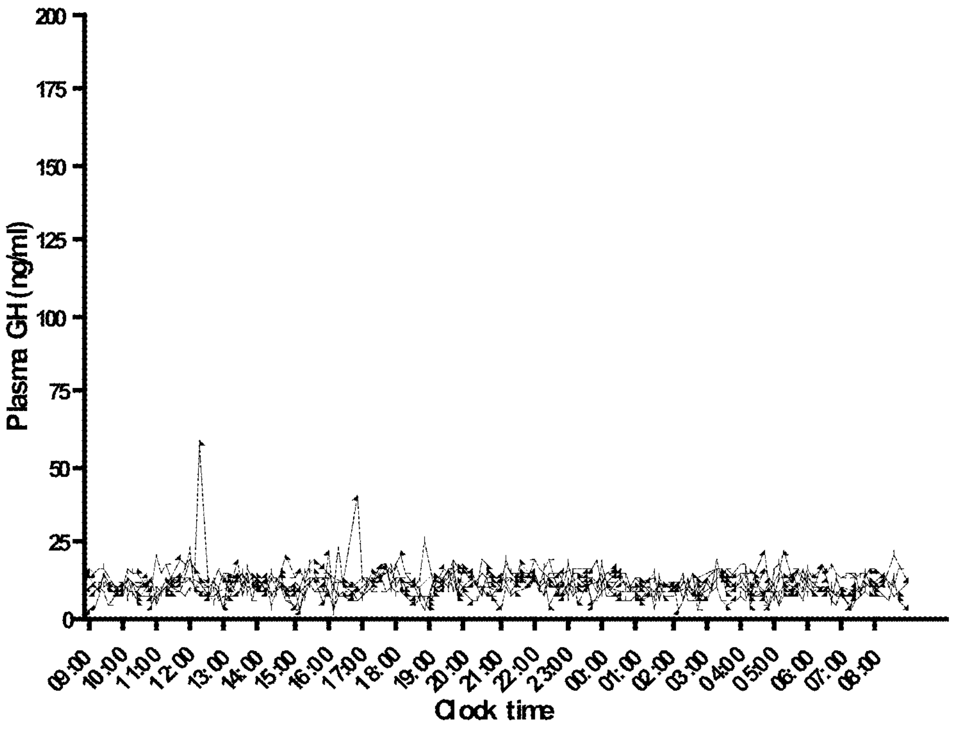
Figure 9C:
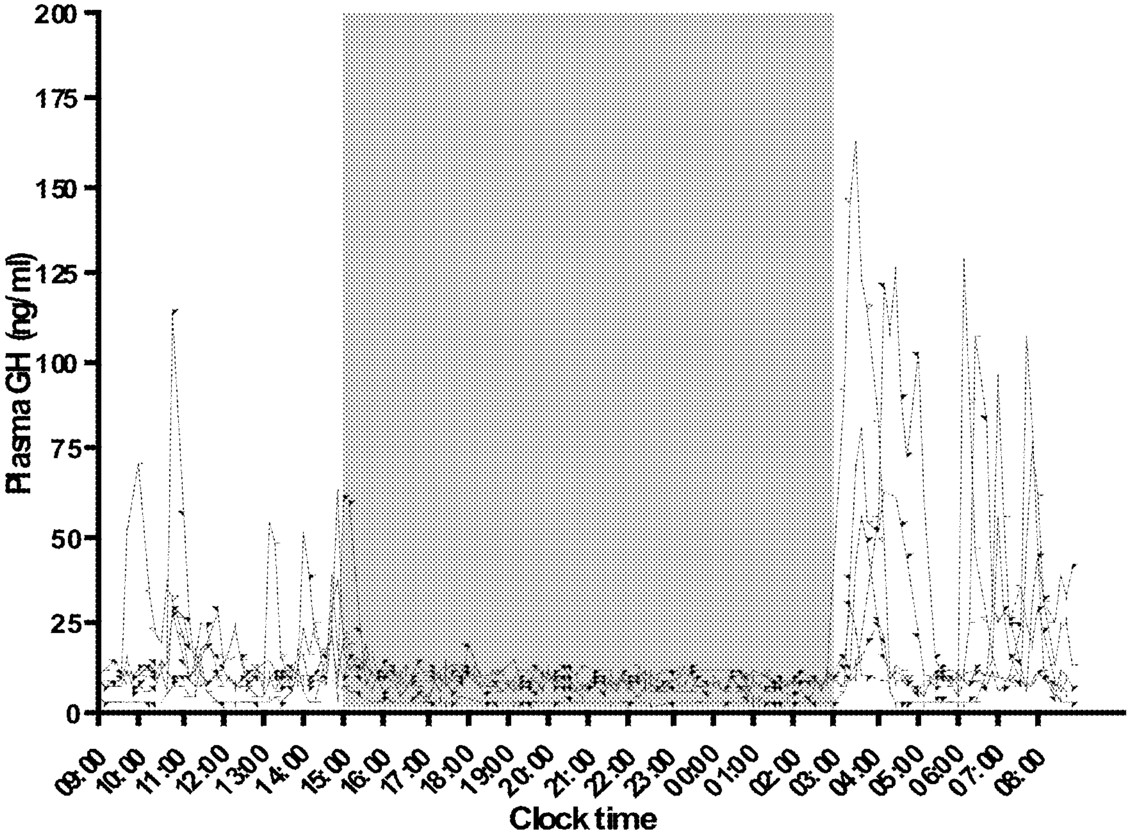

FIG. 9*b* shows the effects of i.v. administration of CP-GHRH-LHD (SXN101000) (SEQ ID NO: 36) on rat GH levels on day 5 days after treatment compared to a vehical only control (FIG. 9*a*) and Octreotide infusion (FIG. 9*c*).

EXAMPLES

Example 1 Preparation of a $LH_N$/C backbone construct
Example 2 Construction of $LH_N$/C-human GHRP
Example 3 Expression and purification of a $LH_N$/C-human GHRP fusion
Example 4 Construction of $LH_N$/D-CP-qGHRH29 fusion protein
Example 5 Expression and purification of a $LH_N$/D-CP-qGHRH29 fusion protein
Example 6 Chemical conjugation of $LH_N$/A to SST TM
Example 7 Method for treating colorectal cancer
Example 8 Method for treating breast cancer
Example 9 Method for treating prostate cancer
Example 10 Method for treating small cell lung cancer
Example 11 Method for treating colorectal cancer
Example 12 Method for treating small cell lung cancer
Example 13 Method for treating prostate cancer
Example 14 Method for treating small cell lung cancer
Example 15 Method for treating breast cancer
Example 16 Method for treating colorectal cancer
Example 17 Method for treating prostate cancer
Example 18 Method for treating small cell lung cancer
Example 19 Method for treating colorectal cancer
Example 20 Method for treating breast cancer
Example 21 Method for treating colorectal cancer
Example 22 Method for treating prostate cancer
Example 23 Method for treating breast cancer
Example 24 Method for treating small cell lung cancer
Example 25 Method for treating colorectal cancer
Example 26 Method for treating prostate cancer
Example 27 Method for treating breast cancer
Example 28 Method for treating small cell lung cancer
Example 29 Binding, secretion and in vivo assay
Example 30 Method for treating non-small cell lung cancer
Example 31 Method for treating non-small cell lung cancer
Example 32 Method for treating non-small cell lung cancer
Example 33 Method for treating breast cancer
Example 34 Method for treating small cell lung cancer
Example 35 Method for treating colorectal cancer
Example 36 Method for treating prostate cancer
Example 37 Activity of CP-GHRH-LHD on rat IGF-1 levels in vivo
Example 38 Activity of CP-GHRH-LHD on rat IGF-1 levels in vivo
Example 39 Activity of CP-GHRH-LHD on rat growth hormone levels in vivo SEQ ID NOs Where an initial Met amino acid residue or a corresponding initial codon is indicated in any of the following SEQ ID NOs, said residue/codon is optional.

SEQ ID1 DNA sequence of $LH_N$/A
SEQ ID2 DNA sequence of $LH_N$/B
SEQ ID3 DNA sequence of $LH_N$/C
SEQ ID4 DNA sequence of $LH_N$/D
SEQ ID5 DNA sequence of IgA-$H_N$tet
SEQ ID6 DNA sequence of the human GHRP linker
SEQ ID7 DNA sequence of the human GHRP-C fusion
SEQ ID8 Protein sequence of the human GHRP-C fusion
SEQ ID9 Protein sequence of the human GHRH-D fusion
SEQ ID10 Protein sequence of the human EGF-D fusion
SEQ ID11 Protein sequence of the human NGF-D GS35 fusion
SEQ ID12 Protein sequence of the human LEP116-122-D fusion
SEQ ID13 Protein sequence of the human VIP-D fusion
SEQ ID14 Protein sequence of the human LEP116-122-C fusion
SEQ ID15 Protein sequence of the human IGF1-C fusion
SEQ ID16 Protein sequence of the human SST14-C GS35 fusion
SEQ ID17 Protein sequence of the human GHRP-D fusion
SEQ ID18 Protein sequence of the human IGF1-D fusion
SEQ ID19 Protein sequence of the human NGF-C fusion
SEQ ID20 Protein sequence of the human SST14-D GS20 fusion
SEQ ID21 Protein sequence of the human VIP-C fusion
SEQ ID22 Protein sequence of the human ghrelin-A fusion
SEQ ID23 Protein sequence CP-hGHRH29 N8A K12N M27L-LHD fusion
SEQ ID24 Protein sequence N-terminal-hGHRH29 N8A M27L-LHD fusion
SEQ ID25 Protein sequence of the IgA-$H_N$tet-SST14 Fusion
SEQ ID26 Protein sequence of the IgA-$H_N$tet-GHRP Fusion
SEQ ID27 Protein sequence of the human ghrelin S3W-A fusion
SEQ ID28 Protein sequence of the SST28-D fusion
SEQ ID29 Protein sequence of the GRP-D fusion
SEQ ID30 Protein sequence of the GRP-B fusion
SEQ ID31 DNA sequence of the CP-qGHRH29 linker
SEQ ID32 DNA sequence of the CP-qGHRH29-D fusion
SEQ ID33 Protein sequence of the CP-qGHRH29-D fusion
SEQ ID34 Protein sequence of the CP-qGHRH-A fusion
SEQ ID35 Protein sequence of the CP-qGHRH-C fusion
SEQ ID36 Protein sequence of the CP-qGHRH-D fusion
SEQ ID37 Protein sequence of the CP-qGHRH-D N10-PL5 fusion
SEQ ID38 Protein sequence of the CP-qGHRH-D N10-HX12 fusion
SEQ ID39 Protein sequence of the CP-SST28-D fusion
SEQ ID40 Protein sequence of the CP-SST14-D fusion
SEQ ID41 Protein sequence of the IgA-CP-SST14-$H_N$tet fusion
SEQ ID42 Protein sequence of the CP-UTS-A fusion
SEQ ID43 Protein sequence of the CP-hTGF-B GS10-NS fusion
SEQ ID44 Protein sequence of the CP-hTGF-B GS10-GS20 fusion
SEQ ID45 Protein sequence of $LH_N$/A
SEQ ID46 Protein sequence of $LH_N$/B
SEQ ID47 Protein sequence of $LH_N$/C
SEQ ID48 Protein sequence of $LH_N$/D SEQ ID49 Protein sequence of IgA-$H_N$tet
SEQ ID50 Synthesised Octreotide peptide
SEQ ID51 Synthesised GHRH agonist peptide
SEQ ID52 Synthesised GHRH antagonist peptide
SEQ ID53 Protein sequence of the CP-MCH-D fusion
SEQ ID54 Protein sequence of the KISS-D fusion
SEQ ID55 Protein sequence of the PrRP-A fusion
SEQ ID56 Protein sequence of CP-CRH-C fusion
SEQ ID57 Protein sequence of the CP-HS_GHRH_1-27-LHD fusion
SEQ ID58 Protein sequence of the CP-HS_GHRH_1-28-LHD fusion
SEQ ID59 Protein sequence of the CP-HS_GHRH_1-29-LHD fusion
SEQ ID60 Protein sequence of the CP-HS_GHRH_1-44-LHD fusion
SEQ ID61 Protein sequence of the CP-HS_GHRH_1-40-LHD fusion
SEQ ID62 Protein sequence of the CP-HS_GHRH_Ala9-LHD fusion
SEQ ID63 Protein sequence of the CP-HS_GHRH_Ala22-LHD fusion
SEQ ID64 Protein sequence CP-HS_GHRH_Ala8_Lys11_1-29-LHD fusion
SEQ ID65 Protein CP-HS_GHRH_Ala8_Lys11_Arg12_1-29-LHD fusion
SEQ ID66 Protein sequence CP-HS_GHRH_Ala8_Asn11_1-29-LHD fusion
SEQ ID67 Protein sequence CP-HS_GHRH_Ala8_Lys20_1-29-LHD fusion
SEQ ID68 Protein CP-HS_GHRH_Ala8_Lys11_Lys20_1-29-LHD fusion
SEQ ID69 Protein sequence CP-HS_GHRH_Ala8_Asn20_1-29-LHD fusion
SEQ ID70 Protein sequence CP-HS_GHRH_Ala8_Asn12_1-29-LHD fusion
SEQ ID71 Protein sequence CP-HS_GHRH_Ala8_Asn21_1-29-LHD fusion
SEQ ID72 Protein sequence CP-HS_GHRH_Ala8_Glu_7_1-29-LHD fusion
SEQ ID73 Protein sequence CP-HS_GHRH_Ala8_Glu_10_1-29LHD fusion
SEQ ID74 Protein CP-HS_GHRH_Ala8_Glu_13_1-29-LHD fusion
SEQ ID75 Protein sequence of the CP-HS_GHRH_Ala8-LHD fusion
SEQ ID76 Protein sequence of the CP-HS_GHRH_Glu8_1-29-LHD fusion
SEQ ID77 Protein sequence of the CP-HS-_GHRH_Ala15_1-27-LHD fusion
SEQ ID78 Protein sequence of the CP-HS_GHRH_Ala15-LHD fusion
SEQ ID79 Protein sequence CP-HS_GHRH_Ala8_Ala15_1-29-LHD fusion
SEQ ID80 Protein CP-HS_GHRH_Ala8_9_15_22_27-LHD fusion
SEQ ID81 Protein sequence CP-HS_GHRH_Ala8_9_15_22-LHD fusion
SEQ ID82 Protein sequence CP-HS_GHRH_HVQAL_1-32-LHD fusion
SEQ ID83 Protein sequence CP-HS_GHRH_HVSAL_1-29-LHD fusion
SEQ ID84 Protein sequence CP-HS_GHRH_HVTAL_1-29-LHD fusion
SEQ ID85 Protein sequence CP-HS_GHRH_QALN-LHD fusion
SEQ ID86 Protein sequence CP-HS_GHRH_QAL-LHD fusion
SEQ ID87 Protein sequence CP-hGHRH29 N8A M27L-LHD fusion

Example 1

Preparation of a $LH_N$/C Backbone Construct

The following procedure creates a clone for use as an expression backbone for multidomain fusion expression. This example is based on preparation of a serotype C based clone (SEQ ID3), though the procedures and methods are equally applicable to all $LH_N$ serotypes such as serotype A, B and D (SEQ ID1, 2 and 4) and other protease or translocation domains such as IgA and Tetanus $H_N$ (SEQ ID 5) by using the appropriate published sequence for synthesis or DNA template if creating by PCR amplification (SEQ ID5).

Preparation of Cloning and Expression Vectors pCR 4 (Invitrogen) is the chosen standard cloning vector chosen due to the lack of restriction sequences within the vector and adjacent sequencing primer sites for easy construct confirmation. The expression vector is based on the pET (Novagen) expression vector which has been modified to contain the multiple cloning site NdeI-BamHI-SalI-PstI-XbaI-HindIII for construct insertion, a fragment of the expression vector has been removed to create a non-mobilisable plasmid, a variety of different fusion tags have been inserted to increase purification options and an existing XbaI site in the vector backbone has been removed to simplify sub-cloning.

Preparation of LC/C

The DNA sequence is designed by back translation of the LC/C amino acid sequence (obtained from freely available database sources such as GenBank (accession number P18640) using one of a variety of reverse translation software tools (for example Backtranslation tool v2.0 (Entelechon)). BamHI/SalI recognition sequences are incorporated at the 5' and 3' ends respectively of the sequence maintaining the correct reading frame. The DNA sequence is screened (using software such as SeqBuilder, DNASTAR Inc.) for restriction enzyme cleavage sequences incorporated during the back translation. Any cleavage sequences that are found to be common to those required by the cloning system are removed by the Backtranslation tool from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence containing the LC/C open reading frame (ORF) is then commercially synthesized (for example by Entelechon, Geneart or Sigma-Genosys) and is provided in the pCR 4 vector.

Preparation of $H_N$/C Insert

The DNA sequence is designed by back translation of the $H_N$/C amino acid sequence (obtained from freely available database sources such as GenBank (accession number P18640) using one of a variety of reverse translation software tools (for example Back translation tool v2.0 (Entelechon)). A PstI restriction sequence added to the N-terminus and XbaI-stop codon-HindIII to the C-terminus ensuring the correct reading frame in maintained. The DNA sequence is screened (using software such as SeqBuilder, DNASTAR Inc.) for restriction enzyme cleavage sequences incorporated during the back translation. Any sequences that are found to be common to those required by the cloning system are removed by the Backtranslation tool from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Preparation of the Spacer (LC-$H_N$ Linker)

The LC-HN linker can be designed from first principle, using the existing sequence information for the linker as the template. For example, the serotype C linker (in this case defined as the inter-domain polypeptide region that exists between the cysteines of the disulphide bridge between LC and HN) has the sequence HKAIDGRSLYNKTLD (SEQ ID NO: 179) containing a native Factor Xa cleavage site. This sequence information is freely available from available database sources such as GenBank (accession number P18640) or Swissprot (accession locus BXC1_CLOBO). For generation of a specific protease cleavage site, the native recognition sequence for Factor Xa can be used in the modified sequence VDAIDGRSLYNKTLQ (SEQ ID NO: 180) or an enterokinase activation site can be inserted into the activation loop to generate the sequence such as VDGIITSKTKSDDDDKNKALNLQ (SEQ ID NO: 181). Using one of a variety of reverse translation software tools (for example EditSeq best *E. coli* reverse translation (DNASTAR Inc.), or Backtranslation tool v2.0 (Entelechon)), the DNA sequence encoding the linker region is determined. BamHI/SalI and PstI/XbaI/stop codon/HindIII restriction enzyme sequences are incorporated at either end, in the correct reading frames. The DNA sequence is screened (using software such as MapDraw, DNASTAR Inc.) for restriction enzyme cleavage sequences incorporated during the back translation. Any sequences that are found to be common to those required by the cloning system are removed manually from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Assembly and Confirmation of the Backbone Clone

Due to the small size, the activation linker must be transferred using a two step process. The pCR-4 linker vector is cleaved with BamHI+SalI combination restriction enzymes and the cleaved linker vector then serves as the recipient for BamHI+SalI restriction enzyme cleaved LC DNA. Once the LC encoding DNA is inserted upstream of the linker DNA, the entire LC-linker DNA fragment can then be isolated and transferred to the pET expression vector MCS. The LC-linker is cut out from the pCR 4 cloning vector using BamHI/PstI restriction enzymes digests. The pET expression vector is digested with the same enzymes but is also treated with antarctic phosphatase as an extra precaution to prevent re-circularisation. The LC-linker and the pET vector backbone are gel purified and the purified insert and vector backbone are ligated together using T4 DNA ligase. The product is transformed with TOP10 cells which are then screened for LC-linker using BamHI/PstI restriction digestion. The process is then repeated for the $H_N$ insertion into the PstI/HindIII restriction sites of the pET-LC-linker construct.

Screening with restriction enzymes is sufficient to ensure the final backbone is correct as all components are already sequenced confirmed during synthesis. However, during the sub-cloning of some components into the backbone, where similar size fragments are being removed and inserted, sequencing of a small region to confirm correct insertion is required.

Example 2

Construction of $LH_N$/C-Human GHRP

The following procedure creates a clone for use as an expression construct for multidomain fusion expression where the targeting moiety (TM) is presented C-terminal to the translocation domains. This example is based on preparation of a human GHRP-C fusion (SEQ ID7), though the procedures and methods are equally applicable to create other protease, translocation and TM fusions, where the TM is C-terminal to the translocation domain.

Preparation of Spacer-Human GHRP Insert

For presentation of an GHRP sequence at the C-terminus of the $H_N$ domain, a DNA sequence is designed to flank the spacer and targeting moiety (TM) regions allowing incorporation into the backbone clone (SEQ ID3). The DNA sequence can be arranged as BamHI-SalI-PstI-XbaI-spacer-GHRP-stop codon-HindIII (SEQ ID6). The DNA sequence can be designed using one of a variety of reverse translation software tools (for example EditSeq best *E. coli* reverse translation (DNASTAR Inc.), or Backtranslation tool v2.0 (Entelechon)). Once the TM DNA is designed, the additional DNA required to encode the preferred spacer is created in silico. It is preferred to ensure the correct reading frame is maintained for the spacer, GHRP and restriction sequences and that the XbaI sequence is not preceded by the bases TC, which would result in DAM methylation. The DNA sequence is screened for restriction sequences incorporated and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Insertion of Spacer-Human GHRP into Backbone

In order to create a LC-linker-$H_N$-spacer-GHRP construct (SEQ ID7) using the backbone construct (SEQ ID3) and the newly synthesised pCR 4-spacer-TM vector encoding the GHRP TM (SEQ ID6) a one or two step method can be used; typically the two step method is used when the TM DNA is less than 100 base pairs. Using the one step method the GHRP can be inserted directly into the backbone construct by cutting the pCR 4-spacer-TM vector with XbaI and HindIII restriction enzymes and inserting the TM encoding DNA fragment into a similarly cut pET backbone construct. Using the two-step method the $LH_N$ domain is excised from the backbone clone using restriction enzymes BamHI and XbaI and ligated into similarly digested pCR 4-spacer-GHRP vector. This creates an $LH_N$-spacer-GHRP ORF in pCR 4 that can be excised from the vector using restriction enzymes BamHI and HindIII for subsequent ligation into the similarly cleaved pET expression construct. The final construct contains the LC-linker-$H_N$-spacer-GHRP DNA (SEQ ID7) which will result in a fusion protein containing the sequence illustrated in SEQ ID8.

Screening with restriction enzymes is sufficient to ensure the final backbone is correct as all components are already sequenced confirmed, either during synthesis or following PCR amplification. However, during the sub-cloning of some components into the backbone, where similar size fragments are being removed and inserted, sequencing of a small region to confirm correct insertion is required.

Example 3

Expression and Purification of a $LH_N$/C-Human GHRP Fusion

This example is based on preparation of a human GHRP-C fusion containing the sequence shown in SEQ ID8, where the pET expression vector ORF also encodes a histidine purification tag. These procedures and methods are equally applicable to any C-terminally presented fusion protein of the present invention. Where appropriate, the activation enzyme should be selected to be compatible with the protease activation site within each sequence.

Expression of $LH_N$/C-GHRP Fusion Protein

Expression of the $LH_N$/C-GHRP fusion protein is achieved using the following protocol. Inoculate 100 ml of modified TB containing 0.2% glucosamine and 30 μg/ml kanamycin in a 250 ml flask with a single colony from the $LH_N$/C-GHRP expression strain. Grow the culture at 37° C., 225 rpm for 16 hours. Inoculate 1 L of modified TB containing 0.2% glucosamine and 30 μg/ml kanamycin in a 2 L flask with 10 ml of overnight culture. Grow cultures at 37° C. until an approximate $OD_{600\ nm}$ of 0.5 is reached at which point reduce the temperature to 16° C. After 1 hour induce the cultures with 1 mM IPTG and grow at 16° C. for a further 16 hours.

Purification of $LH_N$/C-GHRP Fusion Protein

Defrost falcon tube containing 35 ml 50 mM HEPES pH 7.2 200 mM NaCl and approximately 10 g of *E. coli* BL21 (DE3) cell paste. Sonicate the cell paste on ice 30 seconds on, 30 seconds off for 10 cycles at a power of 22 microns ensuring the sample remains cool. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2 200 mM NaCl. Using a step gradient of 40 and 100 mM imidazole, wash away the non-specific bound protein and elute the fusion protein with 200 mM imidazole. Dialyse the eluted fusion protein against 5 L of 50 mM HEPES pH 7.2 200 mM NaCl at 4° C. overnight and measure the OD of the dialysed fusion protein. Add 10 mg of Factor Xa per 1 mg fusion protein and incubate at 25° C. static overnight. Load onto a 0.1 M $NiSO_4$ charged Chelating column (20-30 ml column is sufficient) equilibrated with 50 mM HEPES pH 7.2 200 mM NaCl. Wash column to baseline with 50 mM HEPES pH 7.2 200 mM NaCl. Using a step gradient of 40 and 100 mM imidazole, wash away the non-specific bound protein and elute the fusion protein with 200 mM imidazole. Dialyse the eluted fusion protein against 5 L of 50 mM HEPES pH 7.2 150 mM NaCl at 4° C. overnight and concentrate the fusion to about 2 mg/ml, aliquot sample and freeze at −20° C. Test purified protein using OD, BCA and purity analysis. FIG. 1 demonstrates the purified protein as analysed by SDS-PAGE and FIGS. 2, 4, 5 and 6 demonstrate other purified constructs using this methodology

Example 4

Construction of $LH_N$/D-CP-qGHRH29 Fusion Protein

The following procedure creates a clone for use as an expression construct for multidomain fusion expression where the targeting moiety (TM) is presented centrally between the protease and translocation domains. This example is based on preparation of a CP-qGHRH29-D fusion (SEQ ID33), though the procedures and methods are equally applicable to create any other CP fusion of the present invention.

Preparation of CP-qGHRH29 Linker Insert

For presentation of an qGHRH29 sequence at the N-terminus of the $H_N$ domain, a DNA sequence is designed to flank the TM with an activation protease site and spacer regions allowing incorporation into the backbone clone (SEQ ID4). The DNA sequence can be arranged as BamHI-SalI-spacer-protease activation site-qGHRH29-spacer-PstI-XbaI-stop codon-HindIII (SEQ ID31). The DNA sequence can be designed using one of a variety of reverse translation software tools (for example EditSeq best *E. coli* reverse translation (DNASTAR Inc.), or Backtranslation tool v2.0 (Entelechon)). Once the TM DNA is designed, the additional DNA required to encode the preferred spacer is created in silico. It is preferred to ensure the correct reading frame is maintained for the spacers, protease activation site, qGHRH29 and restriction sequences and that the XbaI sequence is not preceded by the bases TC, which would result in DAM methylation. The DNA sequence is screened for restriction sequence incorporated and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Insertion of CP-qGHRH29 Linker into Backbone

In order to create a LC-spacer-activation site-qGHRH29-spacer-$H_N$ construct (SEQ ID32) using the backbone construct (SEQ ID4) and the newly synthesised pCR 4-spacer-activation site-TM-spacer vector encoding the human qGHRH29 TM (SEQ ID31), a one or two step method can be used; typically the two step method is used when the TM DNA is less than 100 base pairs. Using the one step method the qGHRH29 linker region can be inserted directly into the backbone construct buy cutting the pCR 4-spacer-activation site-TM-spacer vector with SalI and PstI restriction enzymes and inserting the TM encoding DNA fragment into a similarly cut pET backbone construct. Using the two-step method the LC domain is excised from the backbone clone using restriction enzymes BamHI and SalI and ligated into similarly digested pCR 4-spacer-activation site-TM-spacer vector. This creates a LC-spacer-activation site-qGHRH29-spacer ORF in pCR 4 that can be excised from the vector using restriction enzymes BamHI and PstI for subsequent ligation into similarly pET expression construct. The final construct contains the LC-spacer-activation site-qGHRH29-spacer-$H_N$ DNA (SEQ ID32) which will result in a fusion protein containing the sequence illustrated in SEQ ID33.

Screening with restriction enzymes is sufficient to ensure the final backbone is correct as all components are already sequenced confirmed, either during synthesis or following PCR amplification. However, during the sub-cloning of some components into the backbone, where similar size fragments are being removed and inserted, sequencing of a small region to confirm correct insertion is required.

Example 5

Expression/Purification $LH_N$/D-CP-qGHRH29 Fusion Protein

This example is based on preparation of a $LH_N$/D-CP-qGHRH29 fusion containing the sequence shown in SEQ ID33, where the pET expression vector ORF also encodes a histidine purification tag. These procedures and methods are equally applicable to any CP fusion protein of the present invention. Where appropriate, the activation enzyme should be selected to be compatible with the protease activation site within each sequence.

Expression of $LH_N$/D-CP-qGHRH29 Fusion Protein

Expression of the $LH_N$/D-CP-qGHRH29 fusion protein is achieved using the following protocol. Inoculate 100 ml of modified TB containing 0.2% glucosamine and 30 μg/ml kanamycin in a 250 ml flask with a single colony from the $LH_N$/D-CP-qGHRH29 expression strain. Grow the culture at 37° C., 225 rpm for 16 hours. Inoculate 1 L of modified TB containing 0.2% glucosamine and 30 μg/ml kanamycin in a 2 L flask with 10 ml of overnight culture. Grow cultures at 37° C. until an approximate $OD_{600\ nm}$ of 0.5 is reached at which point reduce the temperature to 16° C. After 1 hour induce the cultures with 1 mM IPTG and grow at 16° C. for a further 16 hours.

Purification of $LH_N$/D-CP-qGHRH29 Fusion Protein

Defrost falcon tube containing 35 ml 50 mM HEPES pH 7.2 200 mM NaCl and approximately 10 g of *E. coli* BL21 (DE3) cell paste. Sonicate the cell paste on ice 30 seconds on, 30 seconds off for 10 cycles at a power of 22 microns ensuring the sample remains cool. Spin the lysed cells at 18 000 rpm, 4° C. for 30 minutes. Load the supernatant onto a 0.1 M $NiSO_4$ charged Chelating column (20-30 ml column is sufficient) equilibrated with 50 mM HEPES pH 7.2 200 mM NaCl. Using a step gradient of 40 and 100 mM imidazole, wash away the non-specific bound protein and elute the fusion protein with 200 mM imidazole. Dialyse the eluted fusion protein against 5 L of 50 mM HEPES pH 7.2 200 mM NaCl at 4° C. overnight and measure the OD of the dialysed fusion protein. Add 3.2 μl enterokinase (New England Biolabs) per mg fusion protein and incubate at 25° C. static overnight. Load onto a 0.1 M $NiSO_4$ charged Chelating column (20-30 ml column is sufficient) equilibrated with 50 mM HEPES pH 7.2 200 mM NaCl. Wash column to baseline with 50 mM HEPES pH 7.2 200 mM NaCl. Using a step gradient of 40 and 100 mM imidazole, wash away the non-specific bound protein and elute the fusion protein with 200 mM imidazole. Dialyse the eluted fusion protein against 5 L of 50 mM HEPES pH 7.2 150 mM NaCl at 4° C. overnight and concentrate the fusion to about 2 mg/ml, aliquot sample and freeze at −20° C. Test purified protein using OD, BCA and purity analysis.

Example 6

Chemical Conjugation of $LH_N$/A to SST TM

The following procedure creates a chemically conjugated molecule containing the $LH_N$/A amino acid sequence (SEQ ID45), prepared from SEQ ID1 using the production method outlined in example 3, and a SST Octreotide peptide which has been chemically synthesised (SEQ ID50). However, the procedures and methods are equally applicable for the conjugational preparation of any polypeptide of the present invention, for example the conjugation of TMs such as SEQ ID51 or SEQ ID52 to a protease/translocation fusion backbone such as those comprising the amino acid sequences SEQ ID45-49.

The $LH_N$/A protein was buffer exchanged from 50 mM Hepes 150 mM salt into PBSE (100 mM 14.2 g NA2HPO4, 100 mM 5.85 g NaCl, 1 mM EDTANa2 pH 7.5 with 1M HCl) using the Bio-rad PD10 column. This was done by washing one column volume of PBSE through the PD10 column, the protein was then added to the column until no more drops exit the end of the PD10 column. 8 mls of PBSE was then added and 0.5 ml fractions are collected. The collected fractions are the measured using the $A_{280}$ reading and fractions containing protein are pooled. A concentration of 1.55 mg/ml of $LH_N$/A was obtained from the buffer exchange step and this was used to set up the following reactions:

| $LH_N$/A 1.55 mg/ml | 20 mM SPDP or Sulfo-LC-SPDP |
|---|---|
| A 200 μl | 0 |
| B 200 μl | 4 fold increase 0.62 μl |
| C 200 μl | 8 fold increase 1.24 μl |

Sample were left to tumble at RT for 3 hours before being passed down another PD10 column to buffer exchange into PBSE and the protein containing fractions pooled. A final concentration of 25 Mm DTT was then added to derivatised protein and then the samples left at room temperature for 10 minutes. $A_{280}$ and $A_{343}$ readings were then taken to work out the ratio of SPDP:$LH_N$/A interaction and the reaction which resulted in a derivatisation ration of between 1 and 3 was used for the peptide conjugation. The SPDP reagent binds to the primary amines of the $LH_N$/A via an N-hydroxysuccinimide (NHS) ester, leaving the sulphydryl-reactive portion to form a disulphide bond to the free SH group on the free cysteine on the synthesised peptide. In this case the peptide sequence is Octreotide which has been synthesised with a free cysteine on the N-terminus (SEQ ID83). The SPDP-derivatised $LH_N$/A was mixed with a 4-fold excess of the Octreotide ligand and the reaction was then left at RT for 90 minutes whilst tumbling. The excess octreotide was then removed using either a PD10 column leaving $LH_N$/A-Octreotide conjugated molecule.

Example 7

Method for Treating Colorectal Cancer

A 59 year old man diagnosed with a stage II colorectal cancer is treated with usual chemotherapy. To improve the effects of the treatment and to prevent metastasis he receives a transphenoidal injection of a GHRH peptide TM polypeptidep of the invention (e.g. SEQ ID 9, 23-24, 33-38, 57-87). In this case, the polypeptide comprises a protease-translocation fusion backbone of the invention (e.g. BoNT/D protease and translocation domain) chemically conjugated to a GHRH peptide. Within 2 weeks a significant shrinkage of the tumour is observed without appearance of metastasis elsewhere, in correlation with a significant decrease in IGF-1 blood level. The treatment is repeated 3 months later when the IGF-1 blood level starts to rise and 4 weeks later no tumour is observable anymore with the usual detection tools (colonoscopy, CT scan, PET scan, etc.) and the level of carcinoembryonic antigen (CEA) returned to the normal.

Example 8

Method for Treating Breast Cancer

A 52 year old woman diagnosed with a stage II breast cancer is treated with usual chemotherapy. To improve the effects of the treatment and to prevent metastasis she receives a transphenoidal injection of a ghrelin peptide TM fusion protein of the invention (eg. SEQ ID 8, 17, 22, 26-37). Within 4 weeks a significant shrinkage of the tumour is observed without appearance of metastasis elsewhere, in correlation with a significant decrease in IGF-1 blood level. The treatment is repeated 4 months later when the IGF-1 blood level starts to rise again and 6 weeks later no tumour is observable anymore with the usual detection tools (MRI, ultrasound, breast-specific positron emission tomography, mammography, Scintigraphy, etc).

Example 9

Method for Treating Prostate Cancer

A 71 year old man diagnosed with a stage II prostate cancer is treated with hormone therapy. To improve the effects of the treatment and to prevent metastasis he receives an intravenous injection of a GHRH peptide TM fusion protein of the invention (e.g. SEQ ID 9, 23-24, 33-38, 57-87). Within 3 weeks a significant shrinkage of the tumour is observed without appearance of metastasis elsewhere, in correlation with a significant decrease in IGF-1 blood level. The treatment is repeated 3 months later when the IGF-1 blood level starts to rise again and 7 weeks later no tumour is observable anymore with the usual detection tools (X-ray, ProstaScint scan, MRI, transrectal ultrasonography, CT scan, etc.) and the levels of PSA came back to normal.

Example 10

Method for Treating Small Cell Lung Cancer

A 62 year old woman diagnosed with a stage II Small cell lung cancer is treated with usual chemotherapy. To improve the effects of the treatment and to prevent metastasis she receives a transphenoidal injection of a IGF-1 peptide TM fusion protein of the invention (eg. SEQ ID 15, 18). Within 4 weeks a significant decrease in the size of the tumour is observed without appearance of metastasis elsewhere, in correlation with a significant decrease in IGF-1 blood level. The treatment is repeated 4 months later when the IGF-1 blood level starts to rise again and 4 weeks later no tumour is observable anymore with the usual detection tools (X-rays, CT scan, bronchoscopy, etc.) or using the usual blood tests recommended for this cancer.

Example 11

Method for Treating Colorectal Cancer

A 53 year old man diagnosed with a stage II colorectal cancer is treated with usual chemotherapy. To improve the effects of the treatment and to prevent metastasis he receives a transphenoidal injection of a CST or SST peptide TM fusion protein of the invention (eg. SEQ ID 16, 20, 25, 28, 39-41). Within 2 weeks a significant shrinkage of the tumour is observed without appearance of metastasis elsewhere, in correlation with a significant decrease in IGF-1 blood level. The treatment is repeated 3 months later when the IGF-1 blood level starts to rise and 4 weeks later no tumour is observable anymore with the usual detection tools (colonoscopy, CT scan, PET scan, etc.) and the level of carcinoembryonic antigen (CEA) returned to the normal.

Example 12

Method for Treating Small Cell Lung Cancer

A 59 year old man diagnosed with a stage I Small cell lung cancer is treated with usual chemotherapy. To improve the effects of the treatment and to prevent metastasis he receives a transphenoidal injection of a urotensin peptide TM fusion protein of the invention (eg. SEQ ID 42). Within 3 weeks a significant decrease in size of the tumour is observed without appearance of metastasis elsewhere, in correlation with a significant decrease in IGF-1 blood level. The treatment is repeated 4 months later when the IGF-1 blood level starts to rise again and 5 weeks later no tumour is observable anymore with the usual detection tools (X-rays, CT scan, MRI, PET scanning, Radionuclide imaging, bronchoscopy, etc.) or using the usual blood tests recommended for this cancer.

Example 13

Method for Treating Prostate Cancer

A 66 year old man diagnosed with a stage IIc prostate cancer is treated with androgen deprivative treatment. To improve the effects of the treatment and to prevent metastasis he receives a intravenous injection of a CST or SST TM fusion protein of the invention (eg. SEQ ID 16, 20, 25, 28, 39-41). Within 10 days a significant shrinkage of the tumour is observed without appearance of metastasis elsewhere, in correlation with a significant decrease in IGF-1 blood level. The treatment is repeated 2 months later when the IGF-1 blood level starts to rise again and 5 weeks later no tumour is observable anymore with the usual detection tools (X-ray, ProstaScint scan, MRI, transrectal ultrasonography, CT scan, etc.) and the levels of PSA came back to normal.

Example 14

Method for Treating Small Cell Lung Cancer

A 60 year old woman diagnosed with a Small Cell Lung Cancer at a limited stage is treated with surgery. To improve the effects of the treatment and to prevent metastasis she receives a transphenoidal injection of a leptin peptide TM fusion protein of the invention (eg. SEQ ID 12, 14). Within 6 weeks no re-appearance of the tumour is observed, in correlation with a significant decrease in IGF-1 blood level. The treatment is repeated 4 months later when the IGF-1 blood level starts to rise again and 8 weeks later no tumour is observable anymore with the usual detection tools (X-rays, CT scan, MRI, PET scanning, Radionuclide imaging, bronchoscopy, etc.) or using the usual blood tests recommended for this cancer.

Example 15

Method for Treating Breast Cancer

A 62 year old woman diagnosed with a stage III breast cancer is treated with radiation. To improve the effects of the treatment and to prevent metastasis she receives a transphenoidal injection of a VIP peptide TM fusion protein of the invention (eg. SEQ ID 13, 21). Within 10 days significant shrinkage of the tumour is observed without appearance of metastasis elsewhere, in correlation with a significant decrease in IGF-1 blood level. The treatment is repeated 2 months later when the IGF-1 blood level starts to rise again and 3 weeks later no tumour is observable anymore with the usual detection tools (MRI, ultrasound, breast-specific positron emission tomography, mammography, Scintigraphy, etc).

Example 16

Method for Treating Colorectal Cancer

A 50 year old woman diagnosed with a stage III colorectal cancer is treated with surgery. To improve the effects of the treatment and to prevent metastasis she receives a transphenoidal injection of an ErbB peptide fusion protein of the invention (eg. SEQ ID 10). Within 8 weeks no reappearance of the tumour is observed and no appearance of metastasis elsewhere, in correlation with a significant decrease in IGF-1 blood level. The treatment is repeated 4 months later when the IGF-1 blood level starts to rise again and 8 weeks later no tumour is observable anymore with the usual detection tools (colonoscopy, CT scan, PET scan, etc.) and the level of carcinoembryonic antigen (CEA) stays normal.

Example 17

Method for Treating Prostate Cancer

A 67 year old man diagnosed with a stage III prostate cancer is treated with external beam radiation plus hormone therapy. To improve the effects of the treatment and to prevent metastasis he receives a transphenoidal injection of a ghrelin (GHRP) peptide TM fusion protein of the invention (eg. SEQ ID 8, 17, 22, 26-37). Within 3 weeks a significant shrinkage of the tumour is observed without appearance of metastasis elsewhere, in correlation with a significant decrease in IGF-1 blood level. The treatment is repeated 4 months later when the IGF-1 blood level starts to rise again and 7 weeks later no tumour is observable anymore with the usual detection tools (X-ray, ProstaScint scan, MRI, transrectal ultrasonography, CT scan, etc.) and the levels of PSA came back to normal.

Example 18

Method for Treating Small Cell Lung Cancer

A 65 year old man diagnosed with a Small Cell Lung Cancer at extensive stage cancer is treated with usual chemotherapy and radiation to treat the brain metastases. To improve the effects of the treatment and to prevent further metastasis he receives an intravenous injection of a GHRH peptide TM fusion protein of the invention (e.g. SEQ ID 9, 23-24, 33-38, 57-87). Within 4 weeks a significant shrinkage of the tumour and disappearance of the metastasis is observed without appearance of metastasis elsewhere, in correlation with a significant decrease in IGF-1 blood level. The treatment is repeated 3 months later when the IGF-1 blood level starts to rise again and 8 weeks later no tumour is observable anymore with the usual detection tools (X-rays, CT scan, MRI, PET scanning, Radionuclide imaging, bronchoscopy, etc.) or using the usual blood tests recommended for this cancer.

Example 19

Method for Treating Colorectal Cancer

A 66 year old man diagnosed with a stage II colorectal cancer is treated with surgery. To improve the effects of the treatment and to prevent metastasis he receives a transphenoidal injection of an IGF-1 peptide TM fusion protein of the invention (eg. SEQ ID 15, 18). In the next three months no reappearance of the tumour is observed and no metastasis can be detected elsewhere, this is in correlation with a significant decrease in IGF-1 blood level. The treatment is repeated 4 months later when the IGF-1 blood level starts to rise again and 6 months later no tumour is observable with the usual detection tools (colonoscopy, CT scan, PET scan, etc.) and the level of carcinoembryonic antigen (CEA) stays normal.

Example 20

Method for Treating Breast Cancer

A 54 year old woman diagnosed with a stage IIIb breast cancer is treated with neoadjuvant chemotherapy. To improve the effects of the treatment and to prevent metastasis she receives a transphenoidal injection of am ErbB peptide TM fusion protein of the invention (eg. SEQ ID 10). Within 2 weeks a significant shrinkage of the tumour is observed without appearance of metastasis elsewhere, in correlation with a significant decrease in IGF-1 blood level. She is then submitted to a modified radical mastectomy is with reconstruction. 3 months later when the IGF-1 blood level starts to raise again, a new injection is realized and 8 months later no tumour is observable anymore with the usual detection tools (MRI, ultrasound, breast-specific positron emission tomography, mammography, etc).

Example 21

Method for Treating Colorectal Cancer

A 62 year old woman diagnosed with a stage IV colorectal cancer (3 metastasis observed in the liver) is treated with chemotherapy, by injection in liver arteries. To improve the effects of the treatment and to prevent metastasis elsewhere she receives a transphenoidal injection of a bombesin (GRP) peptide TM fusion protein of the invention (eg. SEQ ID 29-30). Within 2 weeks a significant shrinkage of the tumour and the metastasis is observed without appearance of metastasis elsewhere, in correlation with a significant decrease in IGF-1 blood level. Surgery is then realized to remove the tumour and the metatastasis, at the same time. The treatment with the fusion protein is repeated 4 months later when the IGF-1 blood level starts to rise again and 9 months later no tumour is observable anymore with the usual detection tools (colonoscopy, CT scan, PET scan, etc.) and the level of carcinoembryonic antigen (CEA) stays normal.

Example 22

Method for Treating Prostate Cancer

A 73 year old man diagnosed with a stage III prostate cancer is treated with hormone therapy. To improve the effects of the treatment and to prevent metastasis he receives a transphenoidal injection of a VIP peptide TM fusion protein of the invention (eg. SEQ ID 13, 21). Within 6 weeks a significant shrinkage of the tumour is observed without appearance of metastasis elsewhere, in correlation with a significant decrease in IGF-1 blood level. The treatment is repeated 3 months later when the IGF-1 blood level starts to rise again and 5 months later no tumour is observable anymore with the usual detection tools (X-ray, ProstaScint scan, MRI, transrectal ultrasonography, CT scan, etc.) and the levels of PSA came back to normal.

Example 23

Method for Treating Breast Cancer

A 48 year old woman diagnosed with a stage IIIa breast cancer is treated with neoadjuvant chemotherapy. To improve the effects of the treatment and to prevent metastasis she receives a transphenoidal injection of an NGF peptide TM fusion protein of the invention (eg. SEQ ID 11, 19). Within 8 weeks a significant shrinkage of the tumour is observed without appearance of metastasis elsewhere, in correlation with a significant decrease in IGF-1 blood level. A radical mastectomy is then realized with reconstruction. The injection of the fusion protein is repeated 3 months later when the IGF-1 blood level starts to rise again and 8 months later no tumour is observable anymore with the usual detection tools (MRI, ultrasound, breast-specific positron emission tomography, mammography, etc).

Example 24

Method for Treating Small Cell Lung Cancer

A 58 year old man diagnosed with a limited stage Small Cell Lung Cancer cancer is treated with chemotherapy with radiation therapy. To improve the effects of the treatments and to prevent metastasis to appear elsewhere, he receives a transphenoidal injection of a CST or SST peptide TM fusion protein of the invention (eg. SEQ ID 16, 20, 25, 28, 39-41). Within 3 weeks a significant shrinkage of the tumour is observed without appearance of metastasis elsewhere, in correlation with a significant decrease in IGF-1 blood level. The treatment is repeated 3 months later when the IGF-1 blood level starts to rise again and 7 months later no tumour is observable anymore with the usual detection tools (X-rays, CT scan, MRI, PET scanning, Radionuclide imaging, bronchoscopy, etc.) or using the usual blood tests recommended for this cancer.

Example 25

Method for Treating Colorectal Cancer

A 75 year old man diagnosed with a stage II colorectal tumour receives a intravenous injection of a GHRH peptide TM fusion protein of the invention (e.g. SEQ ID 9, 23-24, 33-38, 57-87). Within 2 weeks a significant shrinkage of the tumour is observed without appearance of metastasis elsewhere, in correlation with a significant decrease in IGF-1 blood level. The patient goes then through surgery to remove the tumour. The treatment is repeated 4 months later when the IGF-1 blood level starts to rise again and 8 months later no tumour is observable anymore with the usual detection tools (colonoscopy, CT scan, PET scan, etc.) and the level of carcinoembryonic antigen (CEA) stays normal.

Example 26

Method for Treating Prostate Cancer

A 66 year old man diagnosed with a stage II prostate cancer is treated with brachytherapy and external beam radiation combined. To improve the effects of the treatments and to prevent metastasis he receives a transphenoidal injection of an ErbB peptide TM fusion protein of the invention (eg. SEQ ID 10). Within 5 weeks a significant shrinkage of the tumour is observed without appearance of metastasis elsewhere, in correlation with a significant decrease in IGF-1 blood level. The treatment is repeated 3 months later when the IGF-1 blood level starts to rise again and 6 months later no tumour is observable anymore with the usual detection tools (X-ray, ProstaScint scan, MRI, transrectal ultrasonography, CT scan, etc.) and the levels of PSA came back to normal.

Example 27

Method for Treating Breast Cancer

A 51 year old woman diagnosed with a stage II breast cancer is treated with adjuvant therapies: hormone therapy, chemotherapy, and trastuzumab. To improve the effects of the treatment and to prevent metastasis she receives a transphenoidal injection of a VIP peptide TM fusion protein of the invention (eg. SEQ ID 13, 21). Within 2 weeks a significant shrinkage of the tumour is observed without appearance of metastasis elsewhere, in correlation with a significant decrease in IGF-1 blood level. The treatment is repeated 2 months later when the IGF-1 blood level starts to rise again and 6 months later no tumour is observable anymore with the usual detection tools (MRI, ultrasound, breast-specific positron emission tomography, mammography, etc).

Example 28

Method for Treating Small Cell Lung Cancer

A 56 year old man diagnosed with a Small Cell Lung Cancer at an extensive stage is treated with chemotherapy and radiation therapy. To improve the effects of the treatments and to prevent metastasis elsewhere he receives a transphenoidal injection of a ghrelin peptide TM fusion protein of the invention (eg. SEQ ID 8, 17, 22, 26-37). Within 3 weeks a significant shrinkage of the tumour and a diminution in size of the metastasis is observed without appearance of new metastasis elsewhere, in correlation with a significant decrease in IGF-1 blood level. The treatment is repeated twice after 2 months and 5 months, when the IGF-1 blood level starts to rise again. The patients died 11 months later, 6 months later than expected with this type of treatment and this stage of the disease.

Example 29

Binding, Secretion and In Vivo Assays

To determine the efficacy of the polypeptide fusions we have confirmed their ability to bind appropriate receptors, decrease GH secretion in vivo and in vitro, and to decrease tumour growth in vivo. The following assays are exemplified with GHRH fusion proteins A) Binding Assay:

Primary pituitary cells cultures are established from 6-8 week old male wistar rats. The neurointermediate lobes are dissected out and the remaining tissue is cut into small pieces and transferred to isolation buffer. Cells are then cultured in 24-well plates for 48 hours prior to preparation for the assay.

Using a rapid and sensitive radiometric Scintillation Proximity Assay (SPA) the binding affinity of the GHRH fusion protein is evaluated. In this regard, we incubate rat GHRH membrane fractions with SPA beads and $^{125}$I-labelled GHRH in assay buffer. An 8-points $IC_{50}$ displacement assay is then realized using various concentrations from $10^{-12}$ to $10^{-6}$M of the GHRH-fusion protein to be tested.

8) Secretion Assay:

Using MtT/S cells known to express the GHRH receptor and to secrete Growth Hormone we demonstrate the potency of the GHRH constructs on GH secretion. After 48 h with $10^{-8}$M corticosterone to induce the differentiation of the MtT/S cells, the culture medium is replaced by a culture medium containing 10 nM of the GHRH-fusion-protein (LHnD and double-inactivated LHnD as a control). After 48 h, the MtT/S cells are submitted to a secretion assay using 10 μM forskolin, or 40 mM KCl or $10^{-8}$M GHRH. An example of this type of secretion assay is presented on FIG. 3 using various LHn to determine their efficiency to decrease Growth Hormone from MtT/S cells.

C) In Vivo Assay:

The $LH_N$/A-GHRH (formed by the fusion of $LH_N$/A (SEQ ID NO: 45) and GHRH (SEQ ID NO: 151) and $L_H$/C-GHRH (formed by the fusion of $LH_N$/C (SEQ ID NO: 47) and GHRH (SEQ ID NO: 151)) fusion proteins are tested in a xenograft model of cancer using colorectal cell lines: Caco 2, HT 29, SW 837, or SW 480 transplanted in 4-6 weeks old athymic nude (Nu/Nu) mice. The mice are injected with $0.5\times10^7$ cells. The tumour size is measured by digital caliper twice a week and tumour volumes are estimated according to the formula For an ellipse (short dimension)$^2\times$ (long dimension)/2. When the xenografts reach ~70, ~150, or ~150 mm3, the mice are then randomized to receive (PBS) or the GHRH-fusion-proteins (the active one or the double inactivated version) and the tumours are harvested 4 days after the beginning, of the treatment. Mice are injected with BrdU 2 h prior to sacrifice. BrdU only incorporates in the DNA of dividing cells when they are in S-phase and is then a specific marker of cell proliferation. IGF-1 level is assessed by collecting the blood through cardiac puncture under isoflurane anaesthesia, allowed to clot for 1 h at room temperature and serum collected after centrifugation. IGF-1 is analyzed ELISA according to the manufacturer's instructions. The final size of the tumours is measured and compared, per groups (treated with fusion-proteins: active or not, or untreated) and compared to the IGF-1 levels measured.

Example 30

Method for Treating Non-Small Cell Lung Cancer

A 52 year old male non-smoker diagnosed with a stage II adenocarcinoma, non-small cell lung cancer and undergoing radiotherapy following surgical removal of the tumour is given a transphenoidal injection of a GHRH peptide TM fusion protein of the invention (e.g. SEQ ID 9, 23-24, 33-38, 57-87). Within 4 weeks a significant decrease in the size of the tumour is observed without appearance of metastasis elsewhere, in correlation with a significant decrease in IGF-1 blood level. Radiation therapy is discontinued at this point and tumour size does not increase and there are no metastasis observed. Treatment with the fusion protein is repeated 3 months later when the IGF-1 blood level starts to rise again and tumour size remains stable with no metastasis over the next 3 months without any additional intervention being required.

Example 31

Method for Treating Non-Small Cell Lung Cancer

A 60 year old female smoker diagnosed with a stage IV undifferentiated large cell carcinoma, with metastases in the liver and bone undergoing chemotherapy and radiotherapy is given a transphenoidal injection of an IGF-1 peptide TM fusion protein of the invention (eg. SEQ ID 15, 18). Within 4 weeks blood tests for alkaline phosphatase and alanine aminotransferase indicate reduced tissue damage within the bone and liver indicating reduction in the metatstatic cancer. Bone scans also reveal a reduction in the bone metastase. Disease progression is slowed and at 4 months survival the patient is given a further treatment of the fusion protein.

Example 32

Method for Treating Non-Small Cell Lung Cancer

A 54 year old male smoker diagnosed with a stage I squamous cell carcinoma in the bronchi of the central chest area is given a transphenoidal injection of a GHRH peptide TM fusion protein of the invention (e.g. SEQ ID 9, 23-24, 33-38, 57-87). Within 5 weeks a significant shrinkage of the tumour is observed without appearance of metastasis elsewhere, in correlation with a significant decrease in IGF-1 blood level. The treatment is repeated 5 months later when the IGF-1 blood level starts to rise again and 4 months later no tumour is observable with the usual detection tools (X-rays, CT scan, MRI, PET scanning, Radionuclide imaging, bronchoscopy, etc.) or using the usual blood tests recommended for this cancer.

Example 33

Method for Treating Breast Cancer

A 50 year old woman diagnosed with a stage IIIa breast cancer is treated with neoadjuvant chemotherapy. To improve the effects of the treatment and to prevent metastasis she receives a corticotropin-releasing factor receptor 1 binding peptide TM fusion of the invention (eg. SEQ ID 56). Within 8 weeks a significant shrinkage of the tumour is observed without appearance of metastasis elsewhere, in correlation with a significant decrease in IGF-1 blood level. A radical mastectomy is then realized with reconstruction.

The injection of the fusion protein is repeated 3 months later when the IGF-1 blood level starts to rise again and 8 months later no tumour is observable anymore with the usual detection tools (MRI, ultrasound, breast-specific positron emission tomography, mammography, etc).

Example 34

Method for Treating Small Cell Lung Cancer

A 60 year old man diagnosed with a limited stage Small Cell Lung Cancer cancer is treated with chemotherapy with radiation therapy. To improve the effects of the treatments and to prevent metastasis to appear elsewhere, he receives a transphenoidal injection of a KiSS-10 or KiSS-54 peptide TM fusion of the invention (eg. SEQ ID 54). Within 3 weeks a significant shrinkage of the tumour is observed without appearance of metastasis elsewhere, in correlation with a significant decrease in IGF-1 blood level. The treatment is repeated 3 months later when the IGF-1 blood level starts to rise again and 7 months later no tumour is observable anymore with the usual detection tools (X-rays, CT scan, MRI, PET scanning, Radionuclide imaging, bronchoscopy, etc.) or using the usual blood tests recommended for this cancer.

Example 35

Method for Treating Colorectal Cancer

A 70 year old man diagnosed with a stage II colorectal tumour receives a intravenous injection of a melanin-concentrating hormone peptide TM fusion of the invention (eg. SEQ ID 53). Within 2 weeks a significant shrinkage of the tumour is observed without appearance of metastasis elsewhere, in correlation with a significant decrease in IGF-1 blood level. The patient goes then through surgery to remove the tumour. The treatment is repeated 4 months later when the IGF-1 blood level starts to rise again and 8 months later no tumour is observable anymore with the usual detection tools (colonoscopy, CT scan, PET scan, etc.) and the level of carcinoembryonic antigen (CEA) stays normal.

Example 36

Method for Treating Prostate Cancer

A 40 year old man diagnosed with a stage II prostate cancer is treated with brachytherapy and external beam radiation combined. To improve the effects of the treatments and to prevent metastasis he receives a transphenoidal injection of a prolactin-releasing peptide TM fusion of the invention (eg. SEQ ID 55). Within 5 weeks a significant shrinkage of the tumour is observed without appearance of metastasis elsewhere, in correlation with a significant decrease in IGF-1 blood level. The treatment is repeated 3 months later when the IGF-1 blood level starts to rise again and 6 months later no tumour is observable anymore with the usual detection tools (X-ray, ProstaScint scan, MRI, transrectal ultrasonography, CT scan, etc.) and the levels of PSA came back to normal.

Example 37

Activity of CP-GHRH-LHD on Rat IGF-1 Levels In Vivo

Aims—to assess the impact of i.v. administration of CP-GHRH-LHD fusion (SEQ ID NO: 36) on IGF-1 levels in rats five days after treatment compared with vehicle only treated control.

Materials and Methods

Animals: Adult male Sprague-Dawley rats maintained under standard housing conditions with lights on at 05.00 h (14 L:10 D), food and water available ad libitum and habituated to housing conditions for at least 1 week prior to surgery.

Surgery: On day 1 of the study rats (200-250 g) will be anaesthetised with a combination of Hypnorm (0.32 mg/kg fentanyl citrate and 10 mg/kg fluanisone, i.m.) and diazepam (2.6 mg/kg i.p.). The right jugular vein is exposed and a silastic tipped (i.d. 0.50 mm, o.d. 0.93 mm) polythene cannula (Portex, UK) inserted into the vessel until it lies close to the entrance of the right atrium. Cannulae will be prefilled with heparinised (10 IU/ml) isotonic saline. The free end of the cannulae will be exteriorised through a scalp incision and then tunnelled through a protective spring anchored to the skull using two stainless steel screws and self-curing dental acrylic. Following recovery animals are housed in individual cages in the automated blood sampling room. The end of the protective spring is attached to a mechanical swivel that allows the animal maximum freedom of movement. Cannulae are flushed daily with heparinised saline to maintain patency.

Treatment: At 09:00 on day 2 of the study rats will receive in i.v. injection of CP-GHRH-LHD (SEQ ID NO: 36) or vehicle only control.

Sampling: The automated blood-sampling system (ABS) has been previously described (Clark et al., 1986; Windle et al., 1997). Three to four days after surgery the jugular vein cannula of each animal will be connected to the automated blood-sampling system. At 07:00 on day 6 sampling will begin. Blood samples will be collected at 10 minute intervals using the automated system for a 24 hour period. A total of 144 blood samples will be collected for each will contain no more than 38 μl of whole blood.

Results

The IGF-1 levels were measure using an IGF-1 ELISA kit. FIG. 7 illustrates a statistically significant reduction in the IGF-1 levels in the fusion treated rats compared to the vehicle only control with a t-test P value=0.0416 after only five days.

Example 38

Activity of CP-GHRH-LHD on Rat IGF-1 Levels In Vivo

Aims—to investigate the activity time course for CP-GHRH-LHD fusion (SEQ ID NO: 36) identifying the time delay between administration and initial effect of the compound in IGF-1 levels.

Materials and Methods:

Animals: Adult male Sprague-Dawley rats maintained under standard housing conditions with lights on at 05.00 h (14 L:10 D), food and water available ad libitum and habituated to housing conditions for at least 1 week prior to surgery.

Surgery: On day 1 of the study rats (260-280 g) will be anaesthetised with a combination of Hypnorm and diazepam. The right jugular vein is then exposed and a silastic tipped (i.d. 0.50 mm, o.d. 0.93 mm) polythene cannula (Portex, UK) inserted into the vessel until it lies close to the entrance of the right. Cannulae will be prefilled with heparinised (10 IU/ml) isotonic saline. The free end of the cannulae will be exteriorised through a scalp incision and passed through a spring anchored to the skull using stainless steel screws and dental cement. Following recovery animals will be housed in individual cages in the ABS room. The spring will be attached to a swivel that allows the animal maximum freedom of movement. Cannulae will be flushed daily with heparinised saline to maintain patency.

Treatment: At 10:00 h on day 5 of the study rats will receive in i.v. injection of the CP-GHRH-LHD (SEQ ID NO: 36) or vehicle (sterile saline).

Blood sampling: After flushing the cannulae a single manual blood sample (100 μl) will be taken from each rat at 09.30 h. Samples will be taken from day 5 to day 18 of the experiment (or until the cannulae block). Plasma from blood samples will be stored at −20 C for later analysis of IGF-1 content by ELISA kit.

Results

FIG. 8 illustrates a statistically significant reduction in the IGF-1 levels in the fusion treated rats compared to the vehicle only control from day four after treatment.

Example 39

Activity of CP-GHRH-LHD on Rat GH Levels In Vivo

Aims—to assess the impact of i.v. administration of CP-GHRH-LHD fusion (SEQ ID NO: 36) on growth hormone levels in rats five days after treatment compared with vehicle only treated and Octreotide infusion controls.

Materials and Methods

Animals: Adult male Sprague-Dawley rats maintained under standard housing conditions with lights on at 05.00 h (14 L:10 D), food and water available ad libitum and habituated to housing conditions for at least 1 week prior to surgery.

Surgery: On day 1 of the study rats (200-250 g) will be anaesthetised with a combination of Hypnorm (0.32 mg/kg fentanyl citrate and 10 mg/kg fluanisone, i.m.) and diazepam (2.6 mg/kg i.p.). The right jugular vein is exposed and a silastic tipped (i.d. 0.50 mm, o.d. 0.93 mm) polythene cannula (Portex, UK) inserted into the vessel until it lies close to the entrance of the right atrium. Cannulae will be prefilled with heparinised (10 IU/ml) isotonic saline. The free end of the cannulae will be exteriorised through a scalp incision and then tunnelled through a protective spring anchored to the skull using two stainless steel screws and self-curing dental acrylic. Following recovery animals are housed in individual cages in the automated blood sampling room. The end of the protective spring is attached to a mechanical swivel that allows the animal maximum freedom of movement. Cannulae are flushed daily with heparinised saline to maintain patency.

Treatment: At 09:00 on day 2 of the study rats will receive in i.v. injection of the Syntaxin active compound or vehicle. A 12 hour infusion of somatostatin (or an analogue) will begin 6 hours after the start of sampling (administered via one of the dual cannulae lines) and will continue for 12 hours only. [This infusion timing should be an excellent GH assay control as we should see baseline secretion then complete inhibition and then rapid recovery/rebound]

Sampling: The automated blood-sampling system (ABS) has been previously described (Clark et al., 1986; Windle et al., 1997). Three to four days after surgery the jugular vein cannula of each animal will be connected to the automated blood-sampling system. At 07:00 on day 6 sampling will begin. Blood samples will be collected at 10 minute intervals using the automated system for a 24 hour period. A total of 144 blood samples will be collected for each will contain no more than 38 μl of whole blood.

Results

The growth hormone levels were measure using an RIA assay. FIG. 9*a* illustrates the vehical treated animals which show typical pulsatile release of growth hormone, FIG. 9*b* illustrates the complete ablation of the pulsatile growth hormone release after treatment with GHRH-LHD chimera and FIG. 9*c* shows the blocking of the pulsatile growth hormone release and subsequent recovery when the Octreotide infusion is stopped.

Sequence Listing

SEQ ID 1 $LH_NA$

```
ggatccatggagttcgttaacaaacagttcaactataaagacccagttaacggtgttgacattgcttacatcaaaatcccgaacgctggc
cagatgcagccggtaaaggcattcaaaatccacaacaaaatctgggttatcccggaacgtgatacctttactaacccggaagaaggtg
acctgaacccgccaccggaagcgaaacaggtgccggtatcttactatgactccacctacctgtctaccgataacgaaaaggacaacta
cctgaaaggtgttactaaactgttcgagcgtatttactccaccgacctgggccgtatgctgctgactagcatcgttcgcggtatcccgttctg
gggcggttctaccatcgataccgaactgaaagtaatcgacactaactgcatcaacgttattcagccggacggttcctatcgttccgaaga
actgaacctggtgatcatcggcccgtctgctgatatcatccagttcgagtgtaagagctttggtcacgaagttctgaacctcacccgtaacg
gctacggttccactcagtacatccgtttctctccggacttcaccttcggttttgaagaatccctggaagtagacacgaacccactgctgggc
gctggtaaattcgcaactgatcctgcggttaccctggctcacgaactgattcatgcaggccaccgcctgtacggtatcgccatcaatccga
accgtgtcttcaaagttaacaccaacgcgtattacgagatgtccggtctggaagttagcttcgaagaactgcgtacttttggcggtcacga
cgctaaattcatcgactctctgcaagaaaacgagttccgtctgtactactataacaagttcaaagatatcgcatccaccctgaacaaagc
gaaatccatcgtgggtaccactgcttctctccagtacatgaagaacgtttttaaagaaaaatacctgctcagcgaagacacctccggcaa
attctctgtagacaagttgaaattcgataaactttacaaaatgctgactgaaatttacaccgaagacaacttcgttaagttctttaaagttctg
aaccgcaaaacctatctgaacttcgacaaggcagtattcaaaatcaacatcgtgccgaaagttaactacactatctacgatggtttcaac
ctgcgtaacaccaacctggctgctaattttaacggccagaacacggaaatcaacaacatgaacttcacaaaactgaaaaacttcactg
gtctgttcgagttttacaagctgctgtgcGTCGACGGCATCATTACCTCCAAAACTAAATCTGACGATGACGA
TAAAAACAAAGCGCTGAACCTGCAGtgtatcaaggttaacaactgggatttattcttcagcccgagtgaagacaacttca
ccaacgacctgaacaaaggtgaagaaatcacctcagatactaacatcgaagcagccgaagaaaacatctcgctggacctgatccag
cagtactacctgacctttaatttcgacaacgagccggaaaacatttctatcgaaaacctgagctctgatatcatcggccagctggaactga
tgccgaacatcgaacgtttcccaaacggtaaaaagtacgagctggacaaatataccatgttccactacctgcgcgcgcaggaatttgaa
cacggcaaatcccgtatcgcactgactaactccgttaacgaagctctgctcaacccgtcccgtgtatacaccttcttctctagcgactacgt
gaaaaaggtcaacaaagcgactgaagctgcaatgttcttgggttgggttgaacagcttgtttatgattttaccgacgagacgtccgaagta
tctactaccgacaaaattgcggatatcactatcatcatcccgtacatcggtccggctctgaacattggcaacatgctgtacaaagacgact
tcgttggcgcactgatcttctccggtgcggtgatcctgctggagttcatcccggaaatcgccatcccggtactgggcacctttgctctggtttct
tacattgcaaacaaggttctgactgtacaaaccatcgacaacgcgctgagcaaacgtaacgaaaaatgggatgaagtttacaaatata
tcgtgaccaactggctggctaaggttaatactcagatcgacctcatccgcaaaaaaatgaaagaagcactggaaaaccaggcggaa
gctaccaaggcaatcattaactaccagtacaaccagtacaccgaggaagaaaaaaacaacatcaacttcaacatcgacgatctgtcc
tctaaactgaacgaatccatcaacaaagctatgatcaacatcaacaagttcctgaaccagtgctctgtaagctatctgatgaactccatga
tcccgtacggtgttaaacgtctggaggacttcgatgcgtctctgaaagacgccctgctgaaatacatttacgacaaccgtggcactctgat
cggtcaggttgatcgtctgaaggacaaagtgaacaataccttatcgaccgacatcccttttcagctcagtaaatatgtcgataaccaacgc
cttttgtccactctagaataatgaaagctt
```

-continued

SEQ ID 2 $LH_N$B
ggatccatgccggttaccatcaacaacttcaactacaacgacccgatcgacaacaacaacatcattatgatggaaccgccgttcgcac
gtggtaccggacgttactacaaggcttttaagatcaccgaccgtatctggatcatcccggaacgttacaccttcggttacaaacctgagga
cttcaacaagagtagcgggatttcaatcgtgacgtctgcgagtactatgatccagattatctgaataccaacgataagaagaacatattc
cttcagactatgattaaactcttcaaccgtatcaaaagcaaaccgctcggtgaaaaactcctcgaaatgattatcaacggtatcccgtacc
tcggtgaccgtcgtgtcccgcttgaagagttcaacaccaacatcgcaagcgtcaccgtcaacaaactcatcagcaacccaggtgaagt
cgaacgtaaaaaaggtatcttcgcaaacctcatcatcttcggtccgggtccggtcctcaacgaaaacgaaaccatcgacatcggtatcc
agaaccacttcgcaagccgtgaaggtttcggtggtatcatgcagatgaaattctgcccggaatacgtcagtgtcttcaacaacgtccagg
aaaacaaaggtgcaagcatcttcaaccgtcgtggttacttcagcgacccggcactcatcctcatgcatgaactcatccacgtcctccacg
gtctctacggtatcaaagttgacgacctcccgatcgtcccgaacgagaagaaattcttcatgcagagcaccgacgcaatccaggctga
ggaactctacaccttcggtggccaagacccaagtatcataaccccgtccaccgacaaaagcatctacgacaaagtcctccagaacttc
aggggtatcgtggacagactcaacaaagtcctcgtctgcatcagcgacccgaacatcaatatcaacatatacaagaacaagttcaaa
gacaagtacaaattcgtcgaggacagcgaaggcaaatacagcatcgacgtagaaagtttcgacaagctctacaaaagcctcatgttc
ggtttcaccgaaaccaacatcgccgagaactacaagatcaagacaagggcaagttacttcagcgacagcctcccgcctgtcaaaatc
aagaacctcttagacaacgagatttacacaattgaagagggcttcaacatcagtgacaaagacatggagaaggaatacagaggtca
gaacaaggctatcaacaaacaggcatacgaggagatcagcaaagaacacctcgcagtctacaagatccagatgtgcgtcgacgaa
gaaaagctgtacgacgacgacgacaaagaccgttggggttcttcgctgcagtgcatcgacgttgacaacgaagacctgttcttcatcgct
gacaaaaacagcttcagtgacgacctgagcaaaaacgaacgtatcgaatacaacacccagagcaactacatcgaaaacgacttcc
cgatcaacgaactgatcctggacaccgacctgataagtaaaatcgaactgccgagcgaaaacaccgaaagtctgaccgacttcaac
gttgacgttccggtttacgaaaaacagccggctatcaagaaaatcttcaccgacgaaaacaccatcttccagtacctgtacagccagac
cttcccgctggacatccgtgacatcagtctgaccagcagtttcgacgacgctctgctgttcagcaacaaagtttacagtttcttcagcatgg
actacatcaaaaccgctaacaaagttgttgaagcagggctgttcgctggttgggttaaacagatcgttaacgacttcgttatcgaagctaa
caaaagcaacactatggacgcaatcgctgacatcagtctgatcgttccgtacatcggtctggctctgaacgttggtaacgaaaccgctaa
aggtaactttgaaaacgctttcgagatcgctggtgcaagcatcctgctggagttcatcccggaactgctgatcccggttgttggtgctttcctg
ctggaaagttacatcgacaacaaaaacaagatcatcaaaaccatcgacaacgctctgaccaaacgtaacgaaaaatggagtgatat
gtacggtctgatcgttgctcagtggctgagcaccgtcaacacccagttctacaccatcaaagaaggtatgtacaaagctctgaactacca
ggctcaggctctggaagagatcatcaaataccgttacaacatctacagtgagaaggaaaagagtaacatcaacatcgacttcaacga
catcaacagcaaactgaacgaaggtatcaaccaggctatcgacaacatcaacaacttcatcaacggttgcagtgttagctacctgatga
agaagatgatcccgctggctgttgaaaaactgctggacttcgacaacaccctgaaaaagaacctgctgaactacatcgacgaaaaca
agctgtacctgatcggtagtgctgaatacgaaaaaagtaaagtgaacaaatacctgaagaccatcatgccgttcgacctgagtatctac
accaacgacaccatcctgatcgaaatgttcaacaaatacaactctctagaataatgaaagctt SEQ ID 3 $LH_N$C
ggatccatgccgatcaccatcaacaacttcaactacagcgatccggtggataacaaaaacatcctgtacctggatacccatctgaatac
cctggcgaacgaaccggaaaaagcgtttcgtatcaccggcaacatttgggttattccggatcgttttagccgtaacagcaacccgaatct
gaataaaccgccgcgtgttaccagcccgaaaagcggttattacgatccgaactatctgagcaccgatagcgataaagataccttcctga
aagaaatcatcaaactgttcaaacgcatcaacagccgtgaaattggcgaagaactgatctatcgcctgagcaccgatattccgtttccgg
gcaacaacaacaccccgatcaacacctttgatttcgatgtggatttcaacagcgttgatgttaaaacccgccagggtaacaattgggtga
aaaccggcagcattaacccaagcgtgattattaccggtccgcgcgaaaacattattgatccggaaaccagcacctttaaactgaccaa
caacacctttgcggcgcaggaaggttttggcgcgctgagcattattagcattagcccgcgctttatgctgacctatagcaacgcgaccaa
cgatgttggtgaaggccgtttcagcaaaagcgaattttgcatggacccgatcctgatcctgatgcatgaactgaaccatgcgatgcataa
cctgtatggcatcgcgattccgaacgatcagaccattagcagcgtgaccagcaacatcttttacagccagtacaacgtgaaactggaat
atgcggaaatctatgcgtttggcggtccgaccattgatctgattccgaaaagcgcgcgcaaatacttcgaagaaaaagcgctggattact
atcgcagcattgcgaaacgtctgaacagcattaccaccgcgaatccgagcagcttcaacaaatatatcggcgaatataaacagaaact
gatccgcaaatatcgctttgtggtggaaagcagcggcgaagttaccgttaaccgcaataaattcgtggaactgtacaacgaactgaccc
agatcttcaccgaatttaactatgcgaaaatctataacgtgcagaaccgtaaaatctacctgagcaacgtgtataccccggtgaccgcga
atattctggatgataacgtgtacgatatccagaacggctttaacatcccgaaaagcaacctgaacgttctgtttatgggccagaacctgag
ccgtaatccggcgctgcgtaaagtgaacccggaaaacatgctgtacctgttcaccaaattttgcgtcgacgcgattgatggtcgtagcctg
tacaacaaaaccctgcagtgtcgtgaactgctggtgaaaaacaccgatctgccgtttattggcgatatcagcgatgtgaaaaccgatatc
ttcctgcgcaaagatatcaacgaagaaaccgaagtgatctactacccggataacgtgagcgttgatcaggtgatcctgagcaaaaaca
ccagcgaacatggtcagctggatctgctgtatccgagcattgatagcgaaagcgaaattctgccgggcgaaaaccaggtgttttacgat
aaccgtacccagaacgtggattacctgaacagctattactacctggaaagccagaaactgagcgataacgtggaagattttacctttac
ccgcagcattgaagaagcgctggataacagcgcgaaagtttacacctatttttccgaccctggcgaacaaagttaatgcgggtgttcagg
gcggtctgtttctgatgtgggcgaacgatgtggtggaagatttcaccaccaacatcctgcgtaaagataccctggataaaatcagcgatgt
tagcgcgattattccgtatattggtccggcgctgaacattagcaatagcgtgcgtcgtggcaattttaccgaagcgtttgcggttaccggtgt
gaccattctgctggaagcgtttccggaatttaccattccggcgctgggtgcgtttgtgatctatagcaaagtgcaggaacgcaacgaaatc
atcaaaaccatcgataactgcctggaacagcgtattaaacgctggaaagatagctatgaatggatgatgggcacctggctgagccgtat
tatcacccagttcaacaacatcagctaccagatgtacgatagcctgaactatcaggcgggtgcgattaaagcgaaaatcgatctggaat
acaaaaaatacagcggcagcgataaagaaaacatcaaaagccaggttgaaaacctgaaaaacagcctggatgtgaaaattagcg
aagcgatgaataacatcaacaaattcatccgcgaatgcagcgtgacctacctgttcaaaaacatgctgccgaaagtgatcgatgaact
gaacgaatttgatcgcaacaccaaagcgaaactgatcaacctgatcgatagccacaacattattctggtgggcgaagtggataaactg
aaagcgaaagttaacaacagcttccagaacaccatcccgtttaacatcttcagctataccaacaacagcctgctgaaagatatcatcaa
cgaatacttcaatctagactaataagctt SEQ ID 4 $LH_N$D
ggatccatgacgtggccagttaaggatttcaactactcagatcctgtaaatgacaacgatattctgtaccttcgcattccacaaaataaact
gatcaccacaccagtcaaagcattcatgattactcaaaacatttgggtcattccagaacgcttttctagtgacacaaatccgagtttatctaa
acctccgcgtccgacgtccaaatatcagagctattacgatccctcatatctcagtacggacgaacaaaaagatactttccttaaaggtatc
attaaactgtttaagcgtattaatgagcgcgatatcgggaaaaagttgattaattatcttgttgtgggttccccgttcatgggcgatagctctac
ccccgaagacacttttgatttacccgtcatacgacaaacatcgcggtagagaagtttgagaacggatcgtggaaagtcacaaacatca
ttacacctagcgtcttaattttggtccgctgccaaacatcttagattatacagccagcctgactttgcaggggcaacagtcgaatccgagttt
cgaaggttttggtaccctgagcattctgaaagttgccccggaatttctgctcactttttcagatgtcaccagcaaccagagctcagcagtatt
aggaaagtcaatttttgcatggacccggttattgcactgatgcacgaactgacgcactctctgcatcaactgtatgggatcaacatcccca
gtgacaaacgtattcgtccccaggtgtctgaaggattttctcacaggatgggccgaacgtccagttcgaagagttgtatactttcggaggc
ctggacgtagagatcattccccagattgagcgcagtcagctgcgtgagaaggcattgggccattataaggatattgcaaaacgcctgaa
taacattaacaaaacgattccatcttcgtggatctcgaatattgataaatataagaaaatttttagcgagaaatataattttgataaagataat
acaggtaactttgtggttaacattgacaaattcaactccctttacagtgatttgacgaatgtaatgagcgaagttgtgtatagttcccaataca
acgttaagaatcgtacccattacttctctcgtcactacctgccggttttcgcgaacatccttgacgataatatttacactattcgtgacggctt
taacttgaccaacaagggcttcaatattgaaaattcaggccagaacattgaacgcaacccggccttgcagaaactgtcgagtgaatccgt
ggttgacctgtttaccaaagtctgcgtcgacaaaagcgaagagaagctgtacgatgacgatgacaaagatcgttggggatcgtccctgc -continued agtgtattaaagtgaaaaacaatcggctgccttatgtagcagataaagatagcattagtcaggagattttcgaaaataaaattatcactga
cgaaaccaatgttcagaattattcagataaattttcactggacgaaagcatcttagatggccaagttccgattaacccggaaattgttgatc
cgttactgccgaacgtgaatatggaaccgttaaacctccctggcgaagagatcgtattttatgatgacattacgaaatatgtggactacctt
aattcttattactatttggaaagccagaaactgtccaataacgtggaaaacattactctgaccacaagcgtggaagaggctttaggctact
caaataagatttataccttcctcccgtcgctggcggaaaaagtaaataaaggtgtgcaggctggtctgttcctcaactgggcgaatgaagt
tgtcgaagactttaccacgaatattatgaaaaaggataccctggataaaatctccgacgtctcggttattatcccatatattggccctgcgtt
aaatatcggtaatagtgcgctgcgggggaattttaaccaggcctttgctaccgcgggcgtcgcgttcctcctggagggctttcctgaatttac
tatcccggcgctcggtgtttttacattttactcttccatccaggagcgtgagaaaattatcaaaaccatcgaaaactgcctggagcagcggg
tgaaacgctggaaagattcttatcaatggatggtgtcaaactggttatctcgcatcacgacccaattcaaccatattaattaccagatgtatg
atagtctgtcgtaccaagctgacgccattaaagccaaaattgatctggaatataaaaagtactctggtagcgataaggagaacatcaaa
agccaggtggagaaccttaagaatagtctggatgtgaaaatctctgaagctatgaataacattaacaaattcattcgtgaatgttcggtga
cgtacctgttcaagaatatgctgccaaaagttattgatgaactgaataaatttgatctgcgtaccaaaaccgaacttatcaacctcatcgac
tcccacaacattatccttgtgggcgaagtggatcgtctgaaggccaaagtaaacgagagctttgaaaatacgatgccgtttaatatttttca
tataccaataactccttgctgaaagatatcatcaatgaatatttcaatctagaataataagctt SEQ ID 5 IgA-$H_N$tet
ggatccATGGAGTCCAATCAGCCGGAAAAAAATGGAACCGCGACTAAACCCGAGAATTCGGGG
AACACTACGTCGGAAAACGGCCAGACGGAACCTGAGAAGAAACTGGAACTACGAAATGTGT
CCGATATCGAGCTATACTCTCAAACCAATGGAACCTATAGGCAGCATGTTTCATTGGACGGA
ATCCCAGAAAATACGGATACATATTTCGTCAAAGTGAAGTCTAGCGCATTCAAGGATGTATAT
ATCCCCGTTGCGAGTATTACAGAAGAGAAGCGGAACGGTCAAAGCGTTTATAAGATTACAGC
AAAGGCCGAAAAGTTACAACAGGAGTTAGAAAACAAATACGTTGACAATTTCACTTTTTATCT
CGATAAAAAGGCTAAAGAGGAAAACACGAACTTCACGTCATTTAGTAATCTGGTCAAAGCCA
TAAATCAAAATCCATCTGGTACATACCATCTCGCGGCAAGTCTAAACGCGAATGAAGTAGAA
CTTGGCCCGGACGAGCGTTCATACATTAAGGATACCTTTACTGGCAGACTCATAGGGGAAAA
AGACGGTAAGAACTATGCTATATACAATTTGAAAAAGCCTTTATTTGAGAACCTGTCGGGCG
CCACCGTCGAGAAATTGTCCCTTAAAAACGTAGCTATAAGCGGAAAGAATGACATCGGTAGT
CTTGCAAACGAGGCTACTAACGGGACAAAGATTAAACAAGTGCACGTAGATGGGtgtgtcgacgg
catcattacctccaaaactaaatctgacgatgacgataaaaacaaagcgctgaacctgcagtgcattaaaataaagaatgaggatttg
acattcatcgcagaaaaaaatagcttcagcgaagagccgttccaagatgagatagtaagctacaacaccaagaacaagccgcttaat
tttaattactcgttagataaaatcatagttgactacaaccttcaatcgaagatcacgttaccgaatgacagaacaactcctgtcacaaaag
gaattccctatgcacctgagtataagtcaaatgccgcgtcaacaatagagattcataatatagatgacaacaccatctatcaatatctgta
cgctcagaaaagtccaacaactcttcagcgtataacaatgaccaatagtgtcgatgacgcattgataaattctaccaagatatactcttatt
tcccgagcgtcatctccaaagttaatcaaggtgctcaaggcattctattttgcaatgggtccgagacatcatagatgacttcactaatgagt
cgtctcagaaaaccacgattgataaaatatcagatgtttccaccatcgtcccctacatcggacctgcgcttaacattgtgaagcaggggta
tgaggggaattttatcggagcgttagaaactacggggggttgtgctattacttgaatacataccagagataacattgcccgttatagcggcc
ctcagtatcgcagaatcaagtacacaaaaagaaaagataatcaaaacaatcgacaacttcctagaaaagaggtacgaaaaatggat
agaggtttataaactcgtgaaagcgaaatggttaggcactgttaatacgcagttccaaaagagatcctatcaaatgtatagatcactgga
gtaccaggtggatgccataaagaaaattatcgactatgaatataaaatatattcaggtccagataaggagcagatagctgatgaaataa
acaatttaaaaaacaaacttgaagagaaggcgaataaggccatgatcaatatcaatattttatgcgagaatcttcacgatctttttggtaa
atcagatgattaacgaagccaaaaagcagctgcttgagttcgacacacagtccaaaaacatactaatgcaatatatcaaagcaaactc
aaaattcattggaattactgagctgaagaaactggaatccaaaataaataaagtattctctaccccgatcccgttctcttactctaaaaacc
ttgactgctgggtagataacgaagaagatattgacgttctagagtaataagctt SEQ ID 6 GHRP linker
Catatgccggttggatccatccaggtcgactttaaactgcagggtgttactctagagggcggtggcggtagcggtggcggtggcagcgg
cggtggcggtagcgcactagtgggcagctcatttctgtctccggaacatcaacgggtgcagcagcgtaaagagagtaaaaagccgcc
agcgaaattacagcctcgctaatagaagcttaagggcgaattc SEQ ID 7 GHRP-C fusion
catatgccggttggatccatgccgatcaccatcaacaacttcaactacagcgatccggtggataacaaaaacatcctgtacctggatac
ccatctgaataccctggcgaacgaaccggaaaaagcgtttcgtatcaccggcaacatttgggttattccggatcgttttagccgtaacagc
aacccgaatctgaataaaccgccgcgtgttaccagcccgaaaagcggttattacgatccgaactatctgagcaccgatagcgataaag
ataccttcctgaaagaaatcatcaaactgttcaaacgcatcaacagccgtgaaattggcgaagaactgatctatcgcctgagcaccgat
attccgtttccgggcaacaacaacaccccgatcaacacctttgatttcgatgtggatttcaacagcgttgatgttaaaacccgccagggta
acaattgggtgaaaaccggcagcattaacccgagcgtgattattaccggtccgcgcgaaaacattattgatccggaaaccagcaccttt
aaactgaccaacaacacctttgcggcgcaggaaggttttggcgcgctgagcattattagcattagcccgcgctttatgctgacctatagca
acgcgaccaacgatgttggtgaaggccgtttcagcaaaagcgaattttgcatggacccgatcctgatcctgatgcatgaactgaaccat
gcgatgcataacctgtatggcatcgcgattccgaacgatcagaccattagcagcgtgaccagcaacatcttttacagccagtacaacgt
gaaactggaatatgcggaaatctatgcgtttggcggtccgaccattgatctgattccgaaaagcgcgcgcaaatacttcgaagaaaaag
cgctggattactatcgcagcattgcgaaacgtctgaacagcattaccaccgcgaatccgagcagcttcaacaaatatatcggcgaatat
aaacagaaactgatccgcaaatatcgctttgtggtggaaagcagcggcgaagttaccgttaaccgcaataaattcgtggaactgtacaa
cgaactgacccagatcttcaccgaatttaactatgcgaaaatctataacgtgcagaaccgtaaaatctacctgagcaacgtgtatacccc
ggtgaccgcgaatattctggatgataacgtgtacgatatccagaacggctttaacatcccgaaaagcaacctgaacgttctgtttatgggc
cagaacctgagccgtaatccggcgctgcgtaaagtgaacccggaaaacatgctgtacctgttcaccaaattttgcgtcgacgcgattgat
ggtcgtagcctgtacaacaaaaccctgcagtgtcgtgaactgctggtgaaaaacaccgatctgccgtttattggcgatatcagcgatgtg
aaaaccgatatcttcctgcgcaaagatatcaacgaagaaaccgaagtgatctactacccggataacgtgagcgttgatcaggtgatcct
gagcaaaaacaccagcgaacatggtcagctggatctgctgtatccgagcattgatagcgaaagcgaaattctgccgggcgaaaacc
aggtgttttacgataaccgtacccagaacgtggattacctgaacagctattactacctggaaagccagaaactgagcgataacgtggaa
gattttacctttacccgcagcattgaagaagcgctggataacagcgcgaaagtttacacctattttccgaccctggcgaacaaagttaatg
cgggtgttcagggcggtctgtttctgatgtgggcgaacgatgtggtggaagatttcaccaccaacatcctgcgtaaagataccctggataa
aatcagcgatgttagcgcgattattccgtatattggtccggcgctgaacattagcaatagcgtgcgtcgtggcaattttaccgaagcgtttgc
ggttaccggtgtgaccattctgctggaagcgtttccggaatttaccattccggcgctgggtgcgtttgtgatctatagcaaagtgcaggaac
gcaacgaaatcatcaaaaccatcgataactgcctggaacagcgtattaaacgctggaaagatagctatgaatggatgatgggcacctg
gctgagccgtattatcacccagttcaacaacatcagctaccagatgtacgatagcctgaactatcaggcgggtgcgattaaagcgaaa
atcgatctggaatacaaaaaatacagcggcagcgataaagaaaacatcaaaagccaggttgaaaacctgaaaaacagcctggatg
tgaaaattagcgaagcgatgaataacatcaacaaattcatccgcgaatgcagcgtgacctacctgttcaaaaacatgctgccgaaagt -continued gatcgatgaactgaacgaatttgatcgcaacaccaaagcgaaactgatcaacctgatcgatagccacaacattattctggtgggcgaa
gtggataaactgaaagcgaaagttaacaacagcttccagaacaccatcccgtttaacatcttcagctataccaacaacagcctgctgaa
agatatcatcaacgaatacttcaatctagagggcggtggcggtagcggtggcggtggcagcggcggtggcggtagcgcactagtggg
cagctcatttctgtctccggaacatcaacgggtgcagcagcgtaaagagagtaaaaagccgccagcgaaattacagcctcgctaatag
aagcttaagggcgaattc SEQ ID 8 GHRP-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFNLEGGGG
SGGGGSGGGGSALVGSSFLSPEHQRVQQRKESKKPPAKLQPR SEQ ID 9 GHRH-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVYADAIFTNSYRKVLGQLSARKLLQDIMSRQQGESNQERGA SEQ ID 10 EGF-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVNSDSECPLSHDGYCLHDGVCMYIEALDKYACNCVVGYIGE
RCQYRDLKWWELR SEQ ID 11 NGF-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSGGGGSGGGGSGGGGSGGGGSALVEPHSESNVPAGHTIPQAH
WTKLQHSLDTALRRARSAPAAAIAARVAGQTRNITVDPRLFKKRRLRSPRVLFSTQPPREAADTQ
DLDFEVGGAAPFNRTHRSKRSSSHPIFHRGEFSVCDSVSVWVGDKTTATDIKGKEVMVLGEVNI
NNSVFKQYFFETKCRDPNPVDSGCRGIDSKHWNSYCTTTHTFVKALTMDGKQAAWRFIRIDTAC
VCVLSRKAVRRA SEQ ID 12 LEP116-122-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN -continued TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVSCHLPWA SEQ ID 13 VIP-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVHSDAVFTDNYTRLRKQMAVKKYLNSILN SEQ ID 14 LEP116-122-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFNLEGGGG
SGGGGSGGGGSALVSCHLPWA SEQ ID 15 IGF1-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFNLEGGGG
SGGGGSGGGGSALVGPETLCGAELVDALQFVCGDRGFYFNKPTGYGSSSRRAPQTGIVDECC
FRSCDLRRLEMYCAPLKPAKSA SEQ ID 16 SST-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFNLEGGGG
SGGGGSGGGGSGGGGSGGGGSGGGGSGGGGSALVAGCKNFFWKTFTSC SEQ ID 17 GHRP-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN -continued TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVGSSFLSPEHQRVQQRKESKKPPAKLQPR SEQ ID 18 IGF1-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVGPETLCGAELVDALQFVCGDRGFYFNKPTGYGSSSRRAPQ
TGIVDECCFRSCDLRRLEMYCAPLKPAKSA SEQ ID 19 NGF-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFNLEGGGG
SGGGGSGGGGSALVEPHSESNVPAGHTIPQAHWTKLQHSLDTALRRARSAPAAAIAARVAGQT
RNITVDPRLFKKRRLRSPRVLFSTQPPREAADTQDLDFEVGGAAPFNRTHRSKRSSSHPIFHRG
EFSVCDSVSVWVGDKTTATDIKGKEVMVLGEVNINNSVFKQYFFETKCRDPNPVDSGCRGIDSK
HWNSYCTTTHTFVKALTMDGKQAAWRFIRIDTACVCVLSRKAVRRA SEQ ID 20 SST14-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSGGGGSALVAGCKNFFWKTFTSC SEQ ID 21 VIP-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFNLEGGGG
SGGGGSGGGGSALVHSDAVFTDNYTRLRKQMAVKKYLNSILN SEQ ID 22 ghrelin-A fusion
EFVNKQFNYKDPVNGVDIAYIKIPNAGQMQPVKAFKIHNKIWVIPERDTFTNPEEGDLNPPPEAKQ
VPVSYYDSTYLSTDNEKDNYLKGVTKLFERIYSTDLGRMLLTSIVRGIPFWGGSTIDTELKVIDTNC -continued INVIQPDGSYRSEELNLVIIGPSADIIQFECKSFGHEVLNLTRNGYGSTQYIRFSPDFTFGFEESLE
VDTNPLLGAGKFATDPAVTLAHELIHAGHRLYGIAINPNRVFKVNTNAYYEMSGLEVSFEELRTFG
GHDAKFIDSLQENEFRLYYYNKFKDIASTLNKAKSIVGTTASLQYMKNVFKEKYLLSEDTSGKFSV
DKLKFDKLYKMLTEIYTEDNFVKFFKVLNRKTYLNFDKAVFKINIVPKVNYTIYDGFNLRNTNLAAN
FNGQNTEINNMNFTKLKNFTGLFEFYKLLCVDGIITSKTKSDDDDKNKALNLQCIKVNNWDLFFSP
SEDNFTNDLNKGEEITSDTNIEAAEENISLDLIQQYYLTFNFDNEPENISIENLSSDIIGQLELMPNIE
RFPNGKKYELDKYTMFHYLRAQEFEHGKSRIALTNSVNEALLNPSRVYTFFSSDYVKKVNKATEA
AMFLGWVEQLVYDFTDETSEVSTTDKIADITIIIPYIGPALNIGNMLYKDDFVGALIFSGAVILLEFIPE
IAIPVLGTFALVSYIANKVLTVQTIDNALSKRNEKWDEVYKYIVTNWLAKVNTQIDLIRKKMKEALEN
QAEATKAIINYQYNQYTEEEKNNINFNIDDLSSKLNESINKAMININKFLNQCSVSYLMNSMIPYGV
KRLEDFDASLKDALLKYIYDNRGTLIGQVDRLKDKVNNTLSTDIPFQLSKYVDNQRLLSTLEGGGG
SGGGGSGGGGSALVGSSFLSPEHQRVQQRKESKKPPAKLQPR SEQ ID 23 Protein sequence of the CP-hGHRH29 N8A K12N M27L-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSIEGRYADAIFTASYRNVLGQLSARKLLQDILS
RALAGGGGSGGGGSGGGGSALALQCIKVKNNRLPYVADKDSISQEIFENKIITDETNVQNYSDKFS
LDESILDGQVPINPEIVDPLLPNVNMEPLNLPGEEIVFYDDITKYVDYLNSYYYLESQKLSNNVENITL
TTSVEEALGYSNKIYTFLPSLAEKVNKGVQAGLFLNWANEVVEDFTTNIMKKDTLDKISDVSVIIPYIG
PALNIGNSALRGNFNQAFATAGVAFLLEGFPEFTIPALGVFTFYSSIQEREKIIKTIENCLEQRVKRWK
DSYQWMVSNWLSRITTQFNHINYQMYDSLSYQADAIKAKIDLEYKKYSGSDKENIKSQVENLKNSL
DVKISEAMNNINKFIRECSVTYLFKNMLPKVIDELNKFDLRTKTELINLIDSHNIILVGEVDRLKAKVNE
SFENTMPFNIFSYTNNSLLKDIINEYFN SEQ ID 24 Protein sequence N-termianal-hGHRH29 N8A M27L-LHD fusion
HVDAIFTQSYRKVLAQLSARKLLQDILNRNNNNNNNNNNTWPVKDFNYSDPVNDNDILYLRIPQNKL
ITTPVKAFMITQNIWVIPERFSSDTNPSLSKPPRPTSKYQSYYDPSYLSTDEQKDTFLKGIIKLFKRIN
ERDIGKKLINYLVVGSPFMGDSSTPEDTFDFTRHTTNIAVEKFENGSWKVTNIITPSVLIFGPLPNILD
YTASLTLQGQQSNPSFEGFGTLSILKVAPEFLLTFSDVTSNQSSAVLGKSIFCMDPVIALMHELTHSL
HQLYGINIPSDKRIRPQVSEGFFSQDGPNVQFEELYTFGGLDVEIIPQIERSQLREKALGHYKDIAKR
LNNINKTIPSSWISNIDKYKKIFSEKYNFDKDNTGNFVVNIDKFNSLYSDLTNVMSEVVYSSQYNVKN
RTHYFSRHYLPVFANILDDNIYTIRDGFNLTNKGFNIENSGQNIERNPALQKLSSESVVDLFTKVCVD
KSEEKLYDDDDKDRWGSSLQCIKVKNNRLPYVADKDSISQEIFENKIITDETNVQNYSDKFSLDESIL
DGQVPINPEIVDPLLPNVNMEPLNLPGEEIVFYDDITKYVDYLNSYYYLESQKLSNNVENITLTTSVE
EALGYSNKIYTFLPSLAEKVNKGVQAGLFLNWANEVVEDFTTNIMKKDTLDKISDVSVIIPYIGPALNI
GNSALRGNFNQAFATAGVAFLLEGFPEFTIPALGVFTFYSSIQEREKIIKTIENCLEQRVKRWKDSYQ
WMVSNWLSRITTQFNHINYQMYDSLSYQADAIKAKIDLEYKKYSGSDKENIKSQVENLKNSLDVKIS
EAMNNINKFIRECSVTYLFKNMLPKVIDELNKFDLRTKTELINLIDSHNIILVGEVDRLKAKVNESFENT
MPFNIFSYTNNSLLKDIINEYFN SEQ ID 25 IgA-$H_N$tet-SST14 fusion
ESNQPEKNGTATKPENSGNTTSENGQTEPEKKLELRNVSDIELYSQTNGTYRQHVSLDGIPENTDT
YFVKVKSSAFKDVYIPVASITEEKRNGQSVYKITAKAEKLQQELENKYVDNFTFYLDKKAKEENTNF
TSFSNLVKAINQNPSGTYHLAASLNANEVELGPDERSYIKDTFTGRLIGEKDGKNYAIYNLKKPLFEN
LSGATVEKLSLKNVAISGKNDIGSLANEATNGTKIKQVHVDGCVDGIITSKTKSDDDDKNKALNLQCI
KIKNEDLTFIAEKNSFSEEPFQDEIVSYNTKNKPLNFNYSLDKIIVDYNLQSKITLPNDRTTPVTKGIPY
APEYKSNAASTIEIHNIDDNTIYQYLYAQKSPTTLQRITMTNSVDDALINSTKIYSYFPSVISKVNQGA
QGILFLQWVRDIIDDFTNESSQKTTIDKISDVSTIVPYIGPALNIVKQGYEGNFIGALETTGVVLLLEYIP
EITLPVIAALSIAESSTQKEKIIKTIDNFLEKRYEKWIEVYKLVKAKWLGTVNTQFQKRSYQMYRSLEY
QVDAIKKIIDYEYKIYSGPDKEQIADEINNLKNKLEEKANKAMININIFMRESSRSFLVNQMINEAKKQL
LEFDTQSKNILMQYIKANSKFIGITELKKLESKINKVFSTPIPFSYSKNLDCWVDNEEDIDVLEGGGGS
GGGGSGGGGSALVAGCKNFFWKTFTSC SEQ ID 26 IgA-$H_N$tet-GHRP fusion
ESNQPEKNGTATKPENSGNTTSENGQTEPEKKLELRNVSDIELYSQTNGTYRQHVSLDGIPENTDT
YFVKVKSSAFKDVYIPVASITEEKRNGQSVYKITAKAEKLQQELENKYVDNFTFYLDKKAKEENTNF
TSFSNLVKAINQNPSGTYHLAASLNANEVELGPDERSYIKDTFTGRLIGEKDGKNYAIYNLKKPLFEN
LSGATVEKLSLKNVAISGKNDIGSLANEATNGTKIKQVHVDGCVDGIITSKTKSDDDDKNKALNLQCI
KIKNEDLTFIAEKNSFSEEPFQDEIVSYNTKNKPLNFNYSLDKIIVDYNLQSKITLPNDRTTPVTKGIPY
APEYKSNAASTIEIHNIDDNTIYQYLYAQKSPTTLQRITMTNSVDDALINSTKIYSYFPSVISKVNQGA
QGILFLQWVRDIIDDFTNESSQKTTIDKISDVSTIVPYIGPALNIVKQGYEGNFIGALETTGVVLLLEYIP
EITLPVIAALSIAESSTQKEKIIKTIDNFLEKRYEKWIEVYKLVKAKWLGTVNTQFQKRSYQMYRSLEY
QVDAIKKIIDYEYKIYSGPDKEQIADEINNLKNKLEEKANKAMININIFMRESSRSFLVNQMINEAKKQL
LEFDTQSKNILMQYIKANSKFIGITELKKLESKINKVFSTPIPFSYSKNLDCWVDNEEDIDVLEGGGGS
GGGGSGGGGSALVGSSFLSPEHQRVQQRKESKKPPAKLQPR SEQ ID 27 ghrelin S3W-A fusion
EFVNKQFNYKDPVNGVDIAYIKIPNAGQMQPVKAFKIHNKIWVIPERDTFTNPEEGDLNPPPEAKQV
PVSYYDSTYLSTDNEKDNYLKGVTKLFERIYSTDLGRMLLTSIVRGIPFWGGSTIDTELKVIDTNCINV
IQPDGSYRSEELNLVIIGPSADIIQFECKSFGHEVLNLTRNGYGSTQYIRFSPDFTFGFEESLEVDTN
PLLGAGKFATDPAVTLAHELIHAGHRLYGIAINPNRVFKVNTNAYYEMSGLEVSFEELRTFGGHDAK
FIDSLQENEFRLYYYNKFKDIASTLNKAKSIVGTTASLQYMKNVFKEKYLLSEDTSGKFSVDKLKFDK
LYKMLTEIYTEDNFVKFFKVLNRKTYLNFDKAVFKINIVPKVNYTIYDGFNLRNTNLAANFNGQNTEIN
NMNFTKLKNFTGLFEFYKLLCVDGIITSKTKSDDDDKNKALNLQCIKVNNWDLFFSPSEDNFTNDLN
KGEEITSDTNIEAAEENISLDLIQQYYLTFNFDNEPENISIENLSSDIIGQLELMPNIERFPNGKKYELD
KYTMFHYLRAQEFEHGKSRIALTNSVNEALLNPSRVYTFFSSDYVKKVNKATEAAMFLGWVEQLVY -continued DFTDETSEVSTTDKIADITIIIPYIGPALNIGNMLYKDDFVGALIFSGAVILLEFIPEIAIPVLGTFALVSYIA
NKVLTVQTIDNALSKRNEKWDEVYKYIVTNWLAKVNTQIDLIRKKMKEALENQAEATKAIINYQYNQY
TEEEKNNINFNIDDLSSKLNESINKAMININKFLNQCSVSYLMNSMIPYGVKRLEDFDASLKDALLKYI
YDNRGTLIGQVDRLKDKVNNTLSTDIPFQLSKYVDNQRLLSTLEIYALVGSWFLSPEHQRVQQRKE
SKKPPAKLQPR SEQ ID 28 SST28-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSGGGGSGGGGSALVSANSNPAMAPRERKAGCKNFFWKTFTSC SEQ ID 29 GRP-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FNLEGGGGSGGGGSGGGGSALVGNHWAVGHLM SEQ ID 30 GRP-B fusion
PVTINNFNYNDPIDNNNIIMMEPPFARGTGRYYKAFKITDRIWIIPERYTFGYKPEDFNKSSGIFNR
DVCEYYDPDYLNTNDKKNIFLQTMIKLFNRIKSKPLGEKLLEMIINGIPYLGDRRVPLEEFNTNIASV
TVNKLISNPGEVERKKGIFANLIIFGPGPVLNENETIDIGIQNHFASREGFGGIMQMKFCPEYVSVF
NNVQENKGASIFNRRGYFSDPALILMHELIHVLHGLYGIKVDDLPIVPNEKKFFMQSTDAIQAEELY
TFGGQDPSIITPSTDKSIYDKVLQNFRGIVDRLNKVLVCISDPNININIYKNKFKDKYKFVEDSEGKY
SIDVESFDKLYKSLMFGFTETNIAENYKIKTRASYFSDSLPPVKIKNLLDNEIYTIEEGFNISDKDME
KEYRGQNKAINKQAYEEISKEHLAVYKIQMCVDEEKLYDDDDKDRWGSSLQCIDVDNEDLFFIAD
KNSFSDDLSKNERIEYNTQSNYIENDFPINELILDTDLISKIELPSENTESLTDFNVDVPVYEKQPAI
KKIFTDENTIFQYLYSQTFPLDIRDISLTSSFDDALLFSNKVYSFFSMDYIKTANKVVEAGLFAGWV
KQIVNDFVIEANKSNTMDAIADISLIVPYIGLALNVGNETAKGNFENAFEIAGASILLEFIPELLIPVVG
AFLLESYIDNKNKIIKTIDNALTKRNEKWSDMYGLIVAQWLSTVNTQFYTIKEGMYKALNYQAQAL
EEIIKYRYNIYSEKEKSNINIDFNDINSKLNEGINQAIDNINNFINGCSVSYLMKKMIPLAVEKLLDFD
NTLKKNLLNYIDENKLYLIGSAEYEKSKVNKYLKTIMPFDLSIYTNDTILIEMFNKYNSLEGGGGSG
GGGSGGGGSALVGNHWAVGHLM SEQ ID 31 CP-qGHRH29 linker
ggatccGTCGACaacaacaataacaacaacaataacaacaacgacgatgacgataaaCATGTGGATGCGATCTTT
ACCCAGAGCTATCGGAAGGTTTTGGCCCAACTGTCTGCTCGTAAACTTTTACAGGACATTCT
GAACAGAGCAgaagcggcagccaaagaagcagccgctaaggcgctgcagagtctagaataataagctt SEQ ID 32 CP-qGHRH29-D fusion
ggatccatgacgtggccagttaaggatttcaactactcagatcctgtaaatgacaacgatattctgtaccttcgcattccacaaaataaact
gatcaccacaccagtcaaagcattcatgattactcaaaacatttgggtcattccagaacgcttttctagtgacacaaatccgagtttatctaa
acctccgcgtccgacgtccaaatatcagagctattacgatccctcatatctcagtacggacgaacaaaaagatactttccttaaaggtatc
attaaactgtttaagcgtattaatgagcgcgatatcgggaaaaagttgattaattatcttgttgtgggttccccgttcatgggcgatagctctac
cccgaagacacttttgatttacccgtcatacgacaaacatcgcggtagagaagtttgagaacggatcgtggaaagtcacaaacatca
ttacacctagcgtcttaattttggtccgctgccaaacatcttagattatacagccagcctgactttgcaggggcaacagtcgaatccgagttt
cgaaggttttggtaccctgagcattctgaaagttgccccggaatttctgctcactttttcagatgtcaccagcaaccagagctcagcagtatt
aggaaagtcaatttttgcatggacccggttattgcactgatgcacgaactgacgcactctctgcatcaactgtatgggatcaacatcccca
gtgacaaacgtattcgtccccaggtgtctgaaggattttctcacaggatgggccgaacgtccagttcgaagagttgtatactttcggaggc
ctggacgtagagatcattccccagattgagcgcagtcagctgcgtgagaaggcattgggccattataaggatattgcaaaacgcctgaa
taacattaacaaaacgattccatcttcgtggatctcgaatattgataaatataagaaaatttttagcgagaaatataatttgataaagataat
acaggtaactttgtggttaacattgacaaattcaactccctttacagtgatttgacgaatgtaatgagcgaagttgtgtatagttcccaataca
acgttaagaatcgtacccattacttctctcgtcactacctgccggttttcgcgaacatccttgacgataatatttacactattcgtgacggctt
taacttgaccaacaagggcttcaatattgaaaattcaggccagaacattgaacgcaacccggccttgcagaaactgtcgagtgaatccgt
ggttgacctgtttaccaaagtctgcGTCGACaacaacaataacaacaacaataacaacaacgacgatgacgataaaCATGTG
GATGCGATCTTTACCCAGAGCTATCGGAAGGTTTTGGCCCAACTGTCTGCTCGTAAACTTTT
ACAGGACATTCTGAACAGAGCAgaagcggcagccaaagaagcagccgctaaggcgctgcagtgtattaaagtgaaa
aacaatcggctgccttatgtagcagataaagatagcattagtcaggagattttcgaaaataaaattatcactgacgaaaccaatgttcag
aattattcagataaattttcactggacgaaagcatcttagatggccaagttccgattaacccggaaattgttgatccgttactgccgaacgtg
aatatggaaccgttaaacctccctggcgaagagatcgtattttatgatgacattacgaaatatgtggactaccttaattcttattactatttgga
aagccagaaactgtccaataacgtggaaaacattactctgaccacaagcgtggaagaggctttaggctactcaaataagatttatacctt -continued cctcccgtcgctggcggaaaaagtaaataaaggtgtgcaggctggtctgttcctcaactgggcgaatgaagttgtcgaagactttaccac
gaatattatgaaaaaggataccctggataaaatctccgacgtctcggttattatcccatatattggccctgcgttaaatatcggtaatagtgc
gctgcgggggaattttaaccaggcctttgctaccgcgggcgtcgcgttcctcctggagggctttcctgaatttactatcccggcgctcggtgt
ttttacatttactcttccatccaggagcgtgagaaaattatcaaaaccatcgaaaactgcctggagcagcgggtgaaacgctggaaaga
ttcttatcaatggatggtgtcaaactggttatctcgcatcacgacccaattcaaccatattaattaccagatgtatgatagtctgtcgtaccaa
gctgacgccattaaagccaaaattgatctggaatataaaaagtactctggtagcgataaggagaacatcaaaagccaggtggagaac
cttaagaatagtctggatgtgaaaatctctgaagctatgaataacattaacaaattcattcgtgaatgttcggtgacgtacctgttcaagaat
atgctgccaaaagttattgatgaactgaataaatttgatctgcgtaccaaaaccgaacttatcaacctcatcgactcccacaacattatcctt
gtgggcgaagtggatcgtctgaaggccaaagtaaacgagagctttgaaaatacgatgccgtttaatatttttcatataccaataactcctt
gctgaaagatatcatcaatgaatatttcaatctagaataatgaaagctt SEQ ID 33 CP-qGHRH29-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDNNNNNNNNNNDDDDKHVDAIFTQSYRK
VLAQLSARKLLQDILNRAEAAAKEAAAKALQCIKVKNNRLPYVADKDSISQEIFENKIITDETNVQN
YSDKFSLDESILDGQVPINPEIVDPLLPNVNMEPLNLPGEEIVFYDDITKYVDYLNSYYYLESQKLS
NNVENITLTTSVEEALGYSNKIYTFLPSLAEKVNKGVQAGLFLNWANEVVEDFTTNIMKKDTLDKI
SDVSVIIPYIGPALNIGNSALRGNFNQAFATAGVAFLLEGFPEFTIPALGVFTFYSSIQEREKIIKTIE
NCLEQRVKRWKDSYQWMVSNWLSRITTQFNHINYQMYDSLSYQADAIKAKIDLEYKKYSGSDKE
NIKSQVENLKNSLDVKISEAMNNINKFIRECSVTYLFKNMLPKVIDELNKFDLRTKTELINLIDSHNII
LVGEVDRLKAKVNESFENTMPFNIFSYTNNSLLKDIINEYFN SEQ ID 34 CP-qGHRH-A fusion
EFVNKQFNYKDPVNGVDIAYIKIPNAGQMQPVKAFKIHNKIWVIPERDTFTNPEEGDLNPPPEAKQ
VPVSYYDSTYLSTDNEKDNYLKGVTKLFERIYSTDLGRMLLTSIVRGIPFWGGSTIDTELKVIDTNC
INVIQPDGSYRSEELNLVIIGPSADIIQFECKSFGHEVLNLTRNGYGSTQYIRFSPDFTFGFEESLE
VDTNPLLGAGKFATDPAVTLAHELIHAGHRLYGIAINPNRVFKVNTNAYYEMSGLEVSFEELRTFG
GHDAKFIDSLQENEFRLYYYNKFKDIASTLNKAKSIVGTTASLQYMKNVFKEKYLLSEDTSGKFSV
DKLKFDKLYKMLTEIYTEDNFVKFFKVLNRKTYLNFDKAVFKINIVPKVNYTIYDGFNLRNTNLAAN
FNGQNTEINNMNFTKLKNFTGLFEFYKLLCVDGIITSKTKSLIEGRHVDAIFTQSYRKVLAQLSARK
LLQDILNRQQGERNQEQGALAGGGGSGGGGSGGGGSALVLQCIKVNNWDLFFSPSEDNFTND
LNKGEEITSDTNIEAAEENISLDLIQQYYLTFNFDNEPENISIENLSSDIIGQLELMPNIERFPNGKKY
ELDKYTMFHYLRAQEFEHGKSRIALTNSVNEALLNPSRVYTFFSSDYVKKVNKATEAAMFLGWV
EQLVYDFTDETSEVSTTDKIADITIIIPYIGPALNIGNMLYKDDFVGALIFSGAVILLEFIPEIAIPVLGT
FALVSYIANKVLTVQTIDNALSKRNEKWDEVYKYIVTNWLAKVNTQIDLIRKKMKEALENQAEATK
AIINYQYNQYTEEEKNNINFNIDDLSSKLNESINKAMININKFLNQCSVSYLMNSMIPYGVKRLEDF
DASLKDALLKYIYDNRGTLIGQVDRLKDKVNNTLSTDIPFQLSKYVDNQRLLST SEQ ID 35 CP-qGHRH-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRHVDAIFTQSYRKVLAQLSARKLLQDIL
NRQQGERNQEQGALAGGGGSGGGGSGGGGSALVLQCRELLVKNTDLPFIGDISDVKTDIFLRK
DINEETEVIYYPDNVSVDQVILSKNTSEHGQLDLLYPSIDSESEILPGENQVFYDNRTQNVDYLNS
YYYLESQKLSDNVEDFTFTRSIEEALDNSAKVYTYFPTLANKVNAGVQGGLFLMWANDVVEDFT
TNILRKDTLDKISDVSAIIPYIGPALNISNSVRRGNFTEAFAVTGVTILLEAFPEFTIPALGAFVIYSKV
QERNEIIKTIDNCLEQRIKRWKDSYEWMMGTWLSRIITQFNNISYQMYDSLNYQAGAIKAKIDLEY
KKYSGSDKENIKSQVENLKNSLDVKISEAMNNINKFIRECSVTYLFKNMLPKVIDELNEFDRNTKA
KLINLIDSHNIILVGEVDKLKAKVNNSFQNTIPFNIFSYTNNSLLKDIINEYFN SEQ ID 36 CP-qGHRH-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDGIITSKTKSDDDDKHVDAIFTQSYRKVLA
QLSARKLLQDILNRQQGERNQEQGAALAGGGGSGGGGSGGGGSALALQCIKVKNNRLPYVAD
KDSISQEIFENKIITDETNVQNYSDKFSLDESILDGQVPINPEIVDPLLPNVNMEPLNLPGEEIVFYD
DITKYVDYLNSYYYLESQKLSNNVENITLTTSVEEALGYSNKIYTFLPSLAEKVNKGVQAGLFLNW
ANEVVEDFTTNIMKKDTLDKISDVSVIIPYIGPALNIGNSALRGNFNQAFATAGVAFLLEGFPEFTIP
ALGVFTFYSSIQEREKIIKTIENCLEQRVKRWKDSYQWMVSNWLSRITTQFNHINYQMYDSLSYQ
ADAIKAKIDLEYKKYSGSDKENIKSQVENLKNSLDVKISEAMNNINKFIRECSVTYLFKNMLPKVID
ELNKFDLRTKTELINLIDSHNIILVGEVDRLKAKVNESFENTMPFNIFSYTNNSLLKDIINEYFN SEQ ID 37 CP-qGHRH-D N10-PL5 fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN -continued TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDNNNNNNNNNNDDDDKHVDAIFTQSYRK
VLAQLSARKLLQDILNRQQGERNQEQGAPAPAPLQCIKVKNNRLPYVADKDSISQEIFENKIITDE
TNVQNYSDKFSLDESILDGQVPINPEIVDPLLPNVNMEPLNLPGEEIVFYDDITKYVDYLNSYYYLE
SQKLSNNVENITLTTSVEEALGYSNKIYTFLPSLAEKVNKGVQAGLFLNWANEVVEDFTTNIMKKD
TLDKISDVSVIIPYIGPALNIGNSALRGNFNQAFATAGVAFLLEGFPEFTIPALGVFTFYSSIQEREKI
IKTIENCLEQRVKRWKDSYQWMVSNWLSRITTQFNHINYQMYDSLSYQADAIKAKIDLEYKKYSG
SDKENIKSQVENLKNSLDVKISEAMNNINKFIRECSVTYLFKNMLPKVIDELNKFDLRTKTELINLID
SHNIILVGEVDRLKAKVNESFENTMPFNIFSYTNNSLLKDIINEYFN SEQ ID 38 CP-qGHRH-D N10-HX12 fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDNNNNNNNNNNDDDDKHVDAIFTQSYRKVLAQLSARKLL
QDILNRQQGERNQEQGAEAAAKEAAAKALQCIKVKNNRLPYVADKDSISQEIFENKIITDETNVQNY
SDKFSLDESILDGQVPINPEIVDPLLPNVNMEPLNLPGEEIVFYDDITKYVDYLNSYYYLESQKLSNN
VENITLTTSVEEALGYSNKIYTFLPSLAEKVNKGVQAGLFLNWANEVVEDFTTNIMKKDTLDKISDVS
VIIPYIGPALNIGNSALRGNFNQAFATAGVAFLLEGFPEFTIPALGVFTFYSSIQEREKIIKTIENCLEQR
VKRWKDSYQWMVSNWLSRITTQFNHINYQMYDSLSYQADAIKAKIDLEYKKYSGSDKENIKSQVEN
LKNSLDVKISEAMNNINKFIRECSVTYLFKNMLPKVIDELNKFDLRTKTELINLIDSHNIILVGEVDRLKA
KVNESFENTMPFNIFSYTNNSLLKDIINEYFN SEQ ID 39 CP-SST28-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDGIITSKTKSDDDDKSANSNPAMAPRERK
AGCKNFFWKTFTSCALAGGGGSGGGGSGGGGSALALQCIKVKNNRLPYVADKDSISQEIFENKII
TDETNVQNYSDKFSLDESILDGQVPINPEIVDPLLPNVNMEPLNLPGEEIVFYDDITKYVDYLNSYY
YLESQKLSNNVENITLTTSVEEALGYSNKIYTFLPSLAEKVNKGVQAGLFLNWANEWEDFTTNIM
KKDTLDKISDVSVIIPYIGPALNIGNSALRGNFNQAFATAGVAFLLEGFPEFTIPALGVFTFYSSIQE
REKIIKTIENCLEQRVKRWKDSYQWMVSNWLSRITTQFNHINYQMYDSLSYQADAIKAKIDLEYKK
YSGSDKENIKSQVENLKNSLDVKISEAMNNINKFIRECSVTYLFKNMLPKVIDELNKFDLRTKTELI
NLIDSHNIILVGEVDRLKAKVNESFENTMPFNIFSYTNNSLLKDIINEYFN SEQ ID 40 CP-SST14-D fusion
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDGIITSKTKSDDDDKAGCKNFFWKTFTSC
ALAGGGGSGGGGSGGGGSALALQCIKVKNNRLPYVADKDSISQEIFENKIITDETNVQNYSDKFS
LDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVII
PYIGPALNIGNSALRGNFNQAFATAGVAFLLEGFPEFTIPALGVFTFYSSIQEREKIIKTIENCLEQR
VKRWKDSYQWMVSNWLSRITTQFNHINYQMYDSLSYQADAIKAKIDLEYKKYSGSDKENIKSQV
ENLKNSLDVKISEAMNNINKFIRECSVTYLFKNMLPKVIDELNKFDLRTKTELINLIDSHNIILVGEVD
RLKAKVNESFENTMPFNIFSYTNNSLLKDIINEYFN SEQ ID 41 IgA-CP-SST14-$H_N$tet fusion
ESNQPEKNGTATKPENSGNTTSENGQTEPEKKLELRNVSDIELYSQTNGTYRQHVSLDGIPENT
DTYFVKVKSSAFKDVYIPVASITEEKRNGQSVYKITAKAEKLQQELENKYVDNFTFYLDKKAKEEN
TNFTSFSNLVKAINQNPSGTYHLAASLNANEVELGPDERSYIKDTFTGRLIGEKDGKNYAIYNLKK
PLFENLSGATVEKLSLKNVAISGKNDIGSLANEATNGTKIKQVHVDGCVDGIITSKTKSDDDDKAG
CKNFFWKTFTSCALAGGGGSGGGGSGGGGSALALQCIKIKNEDLTFIAEKNSFSEEPFQDEIVSY
NTKNKPLNFNYSLDKIIVDYNLQSKITLPNDRTTPVTKGIPYAPEYKSNAASTIEIHNIDDNTIYQYLY
AQKSPTTLQRITMTNSVDDALINSTKIYSYFPSVISKVNQGAQGILFLQWVRDIIDDFTNESSQKTTI
DKISDVSTIVPYIGPALNIVKQGYEGNFIGALETTGVVLLLEYIPEITLPVIAALSIAESSTQKEKIIKTI
DNFLEKRYEKWIEVYKLVKAKWLGTVNTQFQKRSYQMYRSLEYQVDAIKKIIDYEYKIYSGPDKE
QIADEINNLKNKLEEKANKAMININIFMRESSRSFLVNQMINEAKKQLLEFDTQSKNILMQYIKANS
KFIGITELKKLESKINKVFSTPIPFSYSKNLDCWVDNEEDIDV SEQ ID 42 CP-UTS-A fusion
EFVNKQFNYKDPVNGVDIAYIKIPNAGQMQPVKAFKIHNKIWVIPERDTFTNPEEGDLNPPPEAKQ
VPVSYYDSTYLSTDNEKDNYLKGVTKLFERIYSTDLGRMLLTSIVRGIPFWGGSTIDTELKVIDTNC
INVIQPDGSYRSEELNLVIIGPSADIIQFECKSFGHEVLNLTRNGYGSTQYIRFSPDFTFGFEESLE
VDTNPLLGAGKFATDPAVTLAHELIHAGHRLYGIAINPNRVFKVNTNAYYEMSGLEVSFEELRTFG
GHDAKFIDSLQENEFRLYYYNKFKDIASTLNKAKSIVGTTASLQYMKNVFKEKYLLSEDTSGKFSV
DKLKFDKLYKMLTEIYTEDNFVKFFKVLNRKTYLNFDKAVFKINIVPKVNYTIYDGFNLRNTNLAAN
FNGQNTEINNMNFTKLKNFTGLFEFYKLLCVDGGGGSADDDDKNDDPPISIDLTFHLLRNMIEMA
RIENEREQAGLNRKYLDEVALAGGGGSGGGGSGGGGSALVLQCIKVNNWDLFFSPSEDNFTND
LNKGEEITSDTNlEAAEENISLDLIQQYYLTFNFDNEPENISIENLSSDIIGQLELMPNIERFPNGKKY -continued ELDKYTMFHYLRAQEFEHGKSRIALTNSVNEALLNPSRVYTFFSSDYVKKVNKATEAAMFLGWV
EQLVYDFTDETSEVSTTDKIADITIIIPYIGPALNIGNMLYKDDFVGALIFSGAVILLEFIPEIAIPVLGT
FALVSYIANKVLTVQTIDNALSKRNEKWDEVYKYIVTNWLAKVNTQIDLIRKKMKEALENQAEATK
AIINYQYNQYTEEEKNNINFNIDDLSSKLNESINKAMININKFLNQCSVSYLMNSMIPYGVKRLEDF
DASLKDALLKYIYDNRGTLIGQVDRLKDKVNNTLSTDIPFQLSKYVDNQRLLST SEQ ID 43 CP-hTGF-B GS10-NS fusion
PVTINNFNYNDPIDNNNIIMMEPPFARGTGRYYKAFKITDRIWIIPERYTFGYKPEDFNKSSGIFNR
DVCEYYDPDYLNTNDKKNIFLQTMIKLFNRIKSKPLGEKLLEMIINGIPYLGDRRVPLEEFNTNIASV
TVNKLISNPGEVERKKGIFANLIIFGPGPVLNENETIDIGIQNHFASREGFGGIMQMKFCPEYVSVF
NNVQENKGASIFNRRGYFSDPALILMHELIHVLHGLYGIKVDDLPIVPNEKKFFMQSTDAIQAEELY
TFGGQDPSIITPSTDKSIYDKVLQNFRGIVDRLNKVLVCISDPNININIYKNKFKDKYKFVEDSEGKY
SIDVESFDKLYKSLMFGFTETNIAENYKIKTRASYFSDSLPPVKIKNLLDNEIYTIEEGFNISDKDME
KEYRGQNKAINKQAYEEISKEHLAVYKIQMCVDGGGGSGGGGSADDDDKVVSHFNDCPDSHTQ
FCFHGTCRFLVQEDKPACVCHSGYVGARCEHADLLAALAKRLVLQCIDVDNEDLFFIADKNSFSD
DLSKNERIEYNTQSNYIENDFPINELILDTDLISKIELPSENTESLTDFNVDVPVYEKQPAIKKIFTDE
NTIFQYLYSQTFPLDIRDISLTSSFDDALLFSNKVYSFFSMDYIKTANKVVEAGLFAGWVKQIVNDF
VIEANKSNTMDAIADISLIVPYIGLALNVGNETAKGNFENAFEIAGASILLEFIPELLIPVVGAFLLESY
IDNKNKIIKTIDNALTKRNEKWSDMYGLIVAQWLSTVNTQFYTIKEGMYKALNYQAQALEEIIKYRY
NIYSEKEKSNINIDFNDINSKLNEGINQAIDNINNFINGCSVSYLMKKMIPLAVEKLLDFDNTLKKNLL
NYIDENKLYLIGSAEYEKSKVNKYLKTIMPFDLSIYTNDTILIEMFNKYNS SEQ ID 44 CP-hTGF-B GS10-GS20 fusion
PVTINNFNYNDPIDNNNIIMMEPPFARGTGRYYKAFKITDRIWIIPERYTFGYKPEDFNKSSGIFNR
DVCEYYDPDYLNTNDKKNIFLQTMIKLFNRIKSKPLGEKLLEMIINGIPYLGDRRVPLEEFNTNIASV
TVNKLISNPGEVERKKGIFANLIIFGPGPVLNENETIDIGIQNHFASREGFGGIMQMKFCPEYVSVF
NNVQENKGASIFNRRGYFSDPALILMHELIHVLHGLYGIKVDDLPIVPNEKKFFMQSTDAIQAEELY
TFGGQDPSIITPSTDKSIYDKVLQNFRGIVDRLNKVLVCISDPNININIYKNKFKDKYKFVEDSEGKY
SIDVESFDKLYKSLMFGFTETNIAENYKIKTRASYFSDSLPPVKIKNLLDNEIYTIEEGFNISDKDME
KEYRGQNKAINKQAYEEISKEHLAVYKIQMCVDGGGGSGGGGSADDDDKVVSHFNDCPDSHTQ
FCFHGTCRFLVQEDKPACVCHSGYVGARCEHADLLAALAGGGGSGGGGSGGGGSALVLQCID
VDNEDLFFIADKNSFSDDLSKNERIEYNTQSNYIENDFPINELILDTDLISKIELPSENTESLTDFNV
DVPVYEKQPAIKKIFTDENTIFQYLYSQTFPLDIRDISLTSSFDDALLFSNKVYSFFSMDYIKTANKV
VEAGLFAGWVKQIVNDFVIEANKSNTMDAIADISLIVPYIGLALNVGNETAKGNFENAFEIAGASILL
EFIPELLIPVVGAFLLESYIDNKNKIIKTIDNALTKRNEKWSDMYGLIVAQWLSTVNTQFYTIKEGMY
KALNYQAQALEEIIKYRYNIYSEKEKSNINIDFNDINSKLNEGINQAIDNINNFINGCSVSYLMKKMIP
LAVEKLLDFDNTLKKNLLNYIDENKLYLIGSAEYEKSKVNKYLKTIMPFDLSIYTNDTILIEMFNKYNS SEQ ID 45 Protein sequence of $LH_N$/A
EFVNKQFNYKDPVNGVDIAYIKIPNAGQMQPVKAFKIHNKIWVIPERDTFTNPEEGDLNPPPEAKQ
VPVSYYDSTYLSTDNEKDNYLKGVTKLFERIYSTDLGRMLLTSIVRGIPFWGGSTIDTELKVIDTNC
INVIQPDGSYRSEELNLVIIGPSADIIQFECKSFGHEVLNLTRNGYGSTQYIRFSPDFTFGFEESLE
VDTNPLLGAGKFATDPAVTLAHELIHAGHRLYGIAINPNRVFKVNTNAYYEMSGLEVSFEELRTFG
GHDAKFIDSLQENEFRLYYYNKFKDIASTLNKAKSIVGTTASLQYMKNVFKEKYLLSEDTSGKFSV
DKLKFDKLYKMLTEIYTEDNFVKFFKVLNRKTYLNFDKAVFKINIVPKVNYTIYDGFNLRNTNLAAN
FNGQNTEINNMNFTKLKNFTGLFEFYKLLCVDGIITSKTKSDDDDKNKALNLQCIKVNNWDLFFSP
SEDNFTNDLNKGEEITSDTNIEAAEENISLDLIQQYYLTFNFDNEPENISIENLSSDIIGQLELMPNIE
RFPNGKKYELDKYTMFHYLRAQEFEHGKSRIALTNSVNEALLNPSRVYTFFSSDYVKKVNKATEA
AMFLGWVEQLVYDFTDETSEVSTTDKIADITIIIPYIGPALNIGNMLYKDDFVGALIFSGAVILLEFIPE
IAIPVLGTFALVSYIANKVLTVQTIDNALSKRNEKWDEVYKYIVTNWLAKVNTQIDLIRKKMKEALEN
QAEATKAIINYQYNQYTEEEKNNINFNIDDLSSKLNESINKAMININKFLNQCSVSYLMNSMIPYGV
KRLEDFDASLKDALLKYIYDNRGTLIGQVDRLKDKVNNTLSTDIPFQLSKYVDNQRLLST SEQ ID 46 Protein sequence of $LH_N$/B
PVTINNFNYNDPIDNNNIIMMEPPFARGTGRYYKAFKITDRIWIIPERYTFGYKPEDFNKSSGIFNR
DVCEYYDPDYLNTNDKKNIFLQTMIKLFNRIKSKPLGEKLLEMIINGIPYLGDRRVPLEEFNTNIASV
TVNKLISNPGEVERKKGIFANLIIFGPGPVLNENETIDIGIQNHFASREGFGGIMQMKFCPEYVSVF
NNVQENKGASIFNRRGYFSDPALILMHELIHVLHGLYGIKVDDLPIVPNEKKFFMQSTDAIQAEELY
TFGGQDPSIITPSTDKSIYDKVLQNFRGIVDRLNKVLVCISDPNININIYKNKFKDKYKFVEDSEGKY
SIDVESFDKLYKSLMFGFTETNIAENYKIKTRASYFSDSLPPVKIKNLLDNEIYTIEEGFNISDKDME
KEYRGQNKAINKQAYEEISKEHLAVYKIQMCVDEEKLYDDDDKDRWGSSLQCIDVDNEDLFFIAD
KNSFSDDLSKNERIEYNTQSNYIENDFPINELILDTDLISKIELPSENTESLTDFNVDVPVYEKQPAI
KKIFTDENTIFQYLYSQTFPLDIRDISLTSSFDDALLFSNKVYSFFSMDYIKTANKVVEAGLFAGWV
KQIVNDFVIEANKSNTMDAIADISLIVPYIGLALNVGNETAKGNFENAFEIAGASILLEFIPELLIPVVG
AFLLESYIDNKNKIIKTIDNALTKRNEKWSDMYGLIVAQWLSTVNTQFYTIKEGMYKALNYQAQAL
EEIIKYRYNIYSEKEKSNINIDFNDINSKLNEGINQAIDNINNFINGCSVSYLMKKMIPLAVEKLLDFD
NTLKKNLLNYIDENKLYLIGSAEYEKSKVNKYLKTIMPFDLSIYTNDTILIEMFNKYNS SEQ ID 47 Protein sequence of $LH_N$/C
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDAIDGRSLYNKTLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA -continued NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFN SEQ ID 48 Protein sequence of LH$_N$/D
TWPVKDFNYSDPVNDNDILYLRIPQNKLITTPVKAFMITQNIWVIPERFSSDTNPSLSKPPRPTSKY
QSYYDPSYLSTDEQKDTFLKGIIKLFKRINERDIGKKLINYLVVGSPFMGDSSTPEDTFDFTRHTTN
IAVEKFENGSWKVTNIITPSVLIFGPLPNILDYTASLTLQGQQSNPSFEGFGTLSILKVAPEFLLTFS
DVTSNQSSAVLGKSIFCMDPVIALMHELTHSLHQLYGINIPSDKRIRPQVSEGFFSQDGPNVQFE
ELYTFGGLDVEIIPQIERSQLREKALGHYKDIAKRLNNINKTIPSSWISNIDKYKKIFSEKYNFDKDN
TGNFVVNIDKFNSLYSDLTNVMSEVVYSSQYNVKNRTHYFSRHYLPVFANILDDNIYTIRDGFNLT
NKGFNIENSGQNIERNPALQKLSSESVVDLFTKVCVDKSEEKLYDDDDKDRWGSSLQCIKVKNN
RLPYVADKDSISQEIFENKIITDETNVQNYSDKFSLDESILDGQVPINPEIVDPLLPNVNMEPLNLPG
EEIVFYDDITKYVDYLNSYYYLESQKLSNNVENITLTTSVEEALGYSNKIYTFLPSLAEKVNKGVQA
GLFLNWANEVVEDFTTNIMKKDTLDKISDVSVIIPYIGPALNIGNSALRGNFNQAFATAGVAFLLEG
FPEFTIPALGVFTFYSSIQEREKIIKTIENCLEQRVKRWKDSYQWMVSNWLSRITTQFNHINYQMY
DSLSYQADAIKAKIDLEYKKYSGSDKENIKSQVENLKNSLDVKISEAMNNINKFIRECSVTYLFKNM
LPKVIDELNKFDLRTKTELINLIDSHNIILVGEVDRLKAKVNESFENTMPFNIFSYTNNSLLKDIINEY
FN SEQ ID 49 Protein sequence of IgA-H$_N$tet
ESNQPEKNGTATKPENSGNTTSENGGQTEPEKKLELRNVSDIELYSQTNGTYRQHVSLDGIPENT
DTYFVKVKSSAFKDVYIPVASITEEKRNGQSVYKITAKAEKLQQELENKYVDNFTFYLDKKAKEEN
TNFTSFSNLVKAINQNPSGTYHLAASLNANEVELGPDERSYIKDTFTGRLIGEKDGKNYAIYNLKK
PLFENLSGATVEKLSLKNVAISGKNDIGSLANEATNGTKIKQVHVDGCVDGIITSKTKSDDDDKNK
ALNLQCIKIKNEDLTFIAEKNSFSEEPFQDEIVSYNTKNKPLNFNYSLDKIIVDYNLQSKITLPNDRT
TPVTKGIPYAPEYKSNAASTIEIHNIDDNTIYQYLYAQKSPTTLQRITMTNSVDDALINSTKIYSYFP
SVISKVNQGAQGILFLQWVRDIIDDFTNESSQKTTIDKISDVSTIVPYIGPALNIVKQGYEGNFIGAL
ETTGVVLLLEYIPEITLPVIAALSIAESSTQKEKIIKTIDNFLEKRYEKWIEVYKLVKAKWLGTVNTQF
QKRSYQMYRSLEYQVDAIKKIIDYEYKIYSGPDKEQIADEINNLKNKLEEKANKAMININIFMRESS
RSFLVNQMINEAKKQLLEFDTQSKNILMQYIKANSKFIGITELKKLESKINKVFSTPIPFSYSKNLDC
WVDNEEDIDV SEQ ID 50 Synthesised Octreotide peptide
Cys-Dphe-Cys-Phe-Dtrp-Lys-Thr-Cys-Thr-ol SEQ ID 51 Synthesised GHRH agonist peptide
HIS-ALA-ASP-ALA-ILE-PHE-THR-ASN-SER-TYR-ARG-LYS-VAL-LEU-GLY-GLN-LEU-SER-
ALA-ARG-LYS-LEU-LEU-GLN-ASP-ILE-NLE-SER-ARG-CYS SEQ ID 52 Synthesised GHRH antagonist peptide
PhAc-Tyr-D-Arg-Asp-Ala-IIe-Phe(4-Cl)-Thr-Ala-Har-Tyr(Me)-His-Lys-Val-Leu-
Abu-Gln-Leu-Ser-Ala-His-Lys-Leu-Leu-Gln-Asp-Ile-Nle-D-Arg-Har-CYS SEQ ID 53 Protein sequence of CP-MCH-D fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKDFDMLRCMLGRVYRPCWQVALAKR
LVLQCIKVKNNRLPYVADKDSISQEIFENKIITDETNVQNYSDKFSLDESILDGQVPINPEIVDPLLPNV
NMEPLNLPGEEIVFYDDITKYVDYLNSYYYLESQKLSNNVENITLTTSVEEALGYSNKIYTFLPSLAEK
VNKGVQAGLFLNWANEVVEDFTTNIMKKDTLDKISDVSVIIPYIGPALNIGNSALRGNFNQAFATAGV
AFLLEGFPEFTIPALGVFTFYSSIQEREKIIKTIENCLEQRVKRWKDSYQWMVSNWLSRITTQFNHIN
YQMYDSLSYQADAIKAKIDLEYKKYSGSDKENIKSQVENLKNSLDVKISEAMNNINKFIRECSVTYLF
KNMLPKVIDELNKFDLRTKTELINLIDSHNIILVGEVDRLKAKVNESFENTMPFNIFSYTNNSLLKDIINE
YFN SEQ ID 54 Protein sequence of KISS-D fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDKSEEKLYDDDDKDRWGSSLQCIKVKNNRLPYVADKDSI
SQEIFENKIITDETNVQNYSDKFSLDESILDGQVPINPEIVDPLLPNVNMEPLNLPGEEIVFYDDITKYV
DYLNSYYYLESQKLSNNVENITLTTSVEEALGYSNKIYTFLPSLAEKVNKGVQAGLFLNWANEVVED
FTTNIMKKDTLDKISDVSVIIPYIGPALNIGNSALRGNFNQAFATAGVAFLLEGFPEFTIPALGVFTFYS
SIQEREKIIKTIENCLEQRVKRWKDSYQWMVSNWLSRITTQFNHINYQMYDSLSYQADAIKAKIDLEY
KKYSGSDKENIKSQVENLKNSLDVKISEAMNNINKFIRECSVTYLFKNMLPKVIDELNKFDLRTKTELI
NLIDSHNIILVGEVDRLKAKVNESFENTMPFNIFSYTNNSLLKDIINEYFNLEGGGGSGGGGSGGGG
SALVYNWNSFGLRFG SEQ ID 55 Protein sequence of PrRP-A fusion
EFVNKQFNYKDPVNGVDIAYIKIPNAGQMQPVKAFKIHNKIWVIPERDTFTNPEEGDLNPPPEAKQV
PVSYYDSTYLSTDNEKDNYLKGVTKLFERIYSTDLGRMLLTSIVRGIPFWGGSTIDTELKVIDTNCINV
IQPDGSYRSEELNLVIIGPSADIIQFECKSFGHEVLNLTRNGYGSTQYIRFSPDFTFGFEESLEVDTN -continued PLLGAGKFATDPAVTLAHELIHAGHRLYGIAINPNRVFKVNTNAYYEMSGLEVSFEELRTFGGHDAK
FIDSLQENEFRLYYYNKFKDIASTLNKAKSIVGTTASLQYMKNVFKEKYLLSEDTSGKFSVDKLKFDK
LYKMLTEIYTEDNFVKFFKVLNRKTYLNFDKAVFKINIVPKVNYTIYDGFNLRNTNLAANFNGQNTEIN
NMNFTKLKNFTGLFEFYKLLCVDGIITSKTKSDDDDKNKALNLQCIKVNNWDLFFSPSEDNFTNDLN
KGEEITSDTNIEAAEENISLDLIQQYYLTFNFDNEPENISIENLSSDIIGQLELMPNIERFPNGKKYELD
KYTMFHYLRAQEFEHGKSRIALTNSVNEALLNPSRVYTFFSSDYVKKVNKATEAAMFLGWVEQLVY
DFTDETSEVSTTDKIADITIIIPYIGPALNIGNMLYKDDFVGALIFSGAVILLEFIPEIAIPVLGTFALVSYIA
NKVLTVQTIDNALSKRNEKWDEVYKYIVTNWLAKVNTQIDLIRKKMKEALENQAEATKAIINYQYNQY
TEEEKNNINFNIDDLSSKLNESINKAMININKFLNQCSVSYLMNSMIPYGVKRLEDFDASLKDALLKYI
YDNRGTLIGQVDRLKDKVNNTLSTDIPFQLSKYVDNQRLLSTLEGGGGSGGGGSGGGGSALVTPD
INPAWYASRGIRPVGRFG SEQ ID 56 Protein sequence of CP-CRH-C fusion
PITINNFNYSDPVDNKNILYLDTHLNTLANEPEKAFRITGNIWVIPDRFSRNSNPNLNKPPRVTSPK
SGYYDPNYLSTDSDKDTFLKEIIKLFKRINSREIGEELIYRLSTDIPFPGNNNTPINTFDFDVDFNSV
DVKTRQGNNWVKTGSINPSVIITGPRENIIDPETSTFKLTNNTFAAQEGFGALSIISISPRFMLTYSN
ATNDVGEGRFSKSEFCMDPILILMHELNHAMHNLYGIAIPNDQTISSVTSNIFYSQYNVKLEYAEIY
AFGGPTIDLIPKSARKYFEEKALDYYRSIAKRLNSITTANPSSFNKYIGEYKQKLIRKYRFVVESSG
EVTVNRNKFVELYNELTQIFTEFNYAKIYNVQNRKIYLSNVYTPVTANILDDNVYDIQNGFNIPKSN
LNVLFMGQNLSRNPALRKVNPENMLYLFTKFCVDGGGGSADDDKSEEPPISLDLTFHLLREVL
EMARAEQLAQQAHSNRKLMEIIALAGGGGSGGGGSGGGGSALVLQCRELLVKNTDLPFIGDISD
VKTDIFLRKDINEETEVIYYPDNVSVDQVILSKNTSEHGQLDLLYPSIDSESEILPGENQVFYDNRT
QNVDYLNSYYYLESQKLSDNVEDFTFTRSIEEALDNSAKVYTYFPTLANKVNAGVQGGLFLMWA
NDVVEDFTTNILRKDTLDKISDVSAIIPYIGPALNISNSVRRGNFTEAFAVTGVTILLEAFPEFTIPAL
GAFVIYSKVQERNEIIKTIDNCLEQRIKRWKDSYEWMMGTWLSRIITQFNNISYQMYDSLNYQAG
AIKAKIDLEYKKYSGSDKENIKSQVENLKNSLDVKISEAMNNINKFIRECSVTYLFKNMLPKVIDELN
EFDRNTKAKLINLIDSHNIILVGEVDKLKAKVNNSFQNTIPFNIFSYTNNSLLKDIINEYFN SEQ ID 57 Protein sequence of CP-HS_GHRH_1-27-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLGQLSARKLLQDI
MALAGGGGSGGGGSGGGGSALALQCIKVKNNRLPYVADKDSISQEIFENKIITDETNVQNYSDKFS
LDESILDGQVPINPEIVDPLLPNVNMEPLNLPGEEIVFYDDITKYVDYLNSYYYLESQKLSNNVENITL
TTSVEEALGYSNKIYTFLPSLAEKVNKGVQAGLFLNWANEVVEDFTTNIMKKDTLDKISDVSVIIPYIG
PALNIGNSALRGNFNQAFATAGVAFLLEGFPEFTIPALGVFTFYSSIQEREKIIKTIENCLEQRVKRWK
DSYQWMVSNWLSRITTQFNHINYQMYDSLSYQADAIKAKIDLEYKKYSGSDKENIKSQVENLKNSL
DVKISEAMNNINKFIRECSVTYLFKNMLPKVIDELNKFDLRTKTELINLIDSHNIILVGEVDRLKAKVNE
SFENTMPFNIFSYTNNSLLKDIINEYFN SEQ ID 58 Protein sequence of the CP-HS_GHRH_1-28-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLGQLSARKLLQDI
MSALAGGGGSGGGGSGGGGSALALQCIKVKNNRLPYVADKDSISQEIFENKIITDETNVQNYSDKF
SLDESILDGQVPINPEIVDPLLPNVNMEPLNLPGEEIVFYDDITKYVDYLNSYYYLESQKLSNNVENIT
LTTSVEEALGYSNKIYTFLPSLAEKVNKGVQAGLFLNWANEVVEDFTTNIMKKDTLDKISDVSVIIPYI
GPALNIGNSALRGNFNQAFATAGVAFLLEGFPEFTIPALGVFTFYSSIQEREKIIKTIENCLEQRVKRW
KDSYQWMVSNWLSRITTQFNHINYQMYDSLSYQADAIKAKIDLEYKKYSGSDKENIKSQVENLKNS
LDVKISEAMNNINKFIRECSVTYLFKNMLPKVIDELNKFDLRTKTELINLIDSHNIILVGEVDRLKAKVN
ESFENTMPFNIFSYTNNSLLKDIINEYFN SEQ ID 59 Protein sequence of the CP-HS_GHRH_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 60 Protein sequence of the CP-HS_GHRH_1-44-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG -continued GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLGQLSARKLLQDI
MSRQQGESNQERGARARLALAGGGGSGGGGSGGGGSALALQCIKVKNNRLPYVADKDSISQEIF
ENKIITDETNVQNYSDKFSLDESILDGQVPINPEIVDPLLPNVNMEPLNLPGEEIVFYDDITKYVDYLN
SYYYLESQKLSNNVENITLTTSVEEALGYSNKIYTFLPSLAEKVNKGVQAGLFLNWANEVVEDFTTNI
MKKDTLDKISDVSVIIPYIGPALNIGNSALRGNFNQAFATAGVAFLLEGFPEFTIPALGVFTFYSSIQER
EKIIKTIENCLEQRVKRWKDSYQWMVSNWLSRITTQFNHINYQMYDSLSYQADAIKAKIDLEYKKYS
GSDKENIKSQVENLKNSLDVKISEAMNNINKFIRECSVTYLFKNMLPKVIDELNKFDLRTKTELINLIDS
HNIILVGEVDRLKAKVNESFENTMPFNIFSYTNNSLLKDIINEYFN SEQ ID 61 Protein sequence of the CP-HS_GHRH_1-40-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLGQLSARKLLQDI
MSRQQGESNQERGALAGGGGSGGGGSGGGGSALALQCIKVKNNRLPYVADKDSISQEIFENKIIT
DETNVQNYSDKFSLDESILDGQVPINPEIVDPLLPNVNMEPLNLPGEEIVFYDDITKYVDYLNSYYYL
ESQKLSNNVENITLTTSVEEALGYSNKIYTFLPSLAEKVNKGVQAGLFLNWANEVVEDFTTNIMKKD
TLDKISDVSVIIPYIGPALNIGNSALRGNFNQAFATAGVAFLLEGFPEFTIPALGVFTFYSSIQEREKIIK
TIENCLEQRVKRWKDSYQWMVSNWLSRITTQFNHINYQMYDSLSYQADAIKAKIDLEYKKYSGSDK
ENIKSQVENLKNSLDVKISEAMNNINKFIRECSVTYLFKNMLPKVIDELNKFDLRTKTELINLIDSHNIIL
VGEVDRLKAKVNESFENTMPFNIFSYTNNSLLKDIINEYFN SEQ ID 62 Protein sequence of the CP-HS_GHRH_Ala9-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNAYRKVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 63 Protein sequence of the CP-HS_GHRH_Ala22-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLGQLSARKALQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 64 Protein sequence CP-HS_GHRH_Ala8_Lys11_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYKKVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 65 Protein CP-HS_GHRH_Ala8_Lys11_Arg12_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI -continued DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYKRVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 66 Protein sequence CP-HS_GHRH_Ala8_Asn11_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYNKVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 67 Protein sequence CP-HS_GHRH_Ala8_Lys20_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYRKVLGQLSAKKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 68 Protein CP-HS_GHRH_Ala8_Lys11_Lys20_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYKKVLGQLSAKKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 69 Protein sequence CP-HS_GHRH_Ala8_Asn20_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYRKVLGQLSANKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 70 Protein sequence CP-HS_GHRH_Ala8_Asn12_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS -continued GQNIERNPALQKLSSESVVDLFTKVCVDGIITSKTKSDDDDKYADAIFTASYRNVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 71 Protein sequence CP-HS_GHRH_Ala8_Asn21_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYRKVLGQLSARNLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 72 Protein sequence CP-HS_GHRH_Ala8_Glu_7_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFEASYRKVLGQLSARNLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 73 Protein sequence CP-HS_GHRH_Ala8_Glu_10_1-29LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASERKVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 74 Protein sequence CP-HS_GHRH_Ala8_Glu_13_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYRKELGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 75 Protein sequence of the CP-HS_GHRH_Ala8-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYRKVLGQLSARKLLQDI -continued MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 76 Protein sequence of the CP-HS_GHRH_Glu8_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTESYRKVLGQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 77 Protein sequence of the CP-HS_GHRH_Ala15_1-27-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLAQLSARKLLQDI
MALAGGGGSGGGGSGGGGSALALQCIKVKNNRLPYVADKDSISQEIFENKIITDETNVQNYSDKFS
LDESILDGQVPINPEIVDPLLPNVNMEPLNLPGEEIVFYDDITKYVDYLNSYYYLESQKLSNNVENITL
TTSVEEALGYSNKIYTFLPSLAEKVNKGVQAGLFLNWANEVVEDFTTNIMKKDTLDKISDVSVIIPYIG
PALNIGNSALRGNFNQAFATAGVAFLLEGFPEFTIPALGVFTFYSSIQEREKIIKTIENCLEQRVKRWK
DSYQWMVSNWLSRITTQFNHINYQMYDSLSYQADAIKAKIDLEYKKYSGSDKENIKSQVENLKNSL
DVKISEAMNNINKFIRECSVTYLFKNMLPKVIDELNKFDLRTKTELINLIDSHNIILVGEVDRLKAKVNE
SFENTMPFNIFSYTNNSLLKDIINEYFN SEQ ID 78 Protein sequence of the CP-HS_GHRH_Ala15-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTNSYRKVLAQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 79 Protein sequence CP-HS_GHRH_Ala8_Ala15_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTASYRKVLAQLSARKLLQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 80 Protein sequence CP-HS_GHRH_Ala8_9_15_22_27-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTAAYRKVLAQLSARKALQDI
ASRALAGGGGSGGGGSGGGGSALALQCIKVKNNRLPYVADKDSISQEIFENKIITDETNVQNYSDK -continued FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 81 Protein sequence of the CP-HS_GHRH_Ala8_9_15_22-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTAAYRKVLAQLSARKALQDI
MSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 82 Protein sequence of the CP-HS_GHRH_HVQAL_1-32-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKHVDAIFTQSYRKVLAQLSARKALQDI
LSRQQGALAGGGGSGGGGSGGGGSALALQCIKVKNNRLPYVADKDSISQEIFENKIITDETNVQNY
SDKFSLDESILDGQVPINPEIVDPLLPNVNMEPLNLPGEEIVFYDDITKYVDYLNSYYYLESQKLSNN
VENITLTTSVEEALGYSNKIYTFLPSLAEKVNKGVQAGLFLNWANEVVEDFTTNIMKKDTLDKISDVS
VIIPYIGPALNIGNSALRGNFNQAFATAGVAFLLEGFPEFTIPALGVFTFYSSIQEREKIIKTIENCLEQR
VKRWKDSYQWMVSNWLSRITTQFNHINYQMYDSLSYQADAIKAKIDLEYKKYSGSDKENIKSQVEN
LKNSLDVKISEAMNNINKFIRECSVTYLFKNMLPKVIDELNKFDLRTKTELINLIDSHNIILVGEVDRLKA
KVNESFENTMPFNIFSYTNNSLLKDIINEYFN SEQ ID 83 Protein sequence of the CP-HS_GHRH_HVSAL_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKHVDAIFTSSYRKVLAQLSARKLLQDI
LSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 84 Protein sequence of the CP-HS_GHRH_HVTAL_1-29-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKHVDAIFTTSYRKVLAQLSARKLLQDI
LSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN SEQ ID 85 Protein sequence of the CP-HS_GHRH_QALN-LHD fusion
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTQSYRKVLAQLSARKALQDI
LNRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI -continued

```
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN
```

SEQ ID 86 Protein sequence of the CP-HS_GHRH_QAL-LHD fusion

```
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSDDDDKYADAIFTQSYRKVLAQLSARKALQDI
LSRALAGGGGSGGGGSGGGGSALALQCIKVKNNRLPYVADKDSISQEIFENKIITDETNVQNYSDK
FSLDESILDGQVPINPEIVDPLLPNVNMEPLNLPGEEIVFYDDITKYVDYLNSYYYLESQKLSNNVENI
TLTTSVEEALGYSNKIYTFLPSLAEKVNKGVQAGLFLNWANEVVEDFTTNIMKKDTLDKISDVSVIIPY
IGPALNIGNSALRGNFNQAFATAGVAFLLEGFPEFTIPALGVFTFYSSIQEREKIIKTIENCLEQRVKR
WKDSYQWMVSNWLSRITTQFNHINYQMYDSLSYQADAIKAKIDLEYKKYSGSDKENIKSQVENLKN
SLDVKISEAMNNINKFIRECSVTYLFKNMLPKVIDELNKFDLRTKTELINLIDSHNIILVGEVDRLKAKV
NESFENTMPFNIFSYTNNSLLKDIINEYFN
```

SEQ ID 87 Protein sequence of the CP-hGHRH29 N8A M27L-LHD fusion

```
TWPVKDFNYSDPVNDNDILYLRIPQNKLITTPVKAFMITQNIWVIPERFSSDTNPSLSKPPRPTSKYQ
SYYDPSYLSTDEQKDTFLKGIIKLFKRINERDIGKKLINYLVVGSPFMGDSSTPEDTFDFTRHTTNIAV
EKFENGSWKVTNIITPSVLIFGPLPNILDYTASLTLQGQQSNPSFEGFGTLSILKVAPEFLLTFSDVTS
NQSSAVLGKSIFCMDPVIALMHELTHSLHQLYGINIPSDKRIRPQVSEGFFSQDGPNVQFEELYTFG
GLDVEIIPQIERSQLREKALGHYKDIAKRLNNINKTIPSSWISNIDKYKKIFSEKYNFDKDNTGNFVVNI
DKFNSLYSDLTNVMSEVVYSSQYNVKNRTHYFSRHYLPVFANILDDNIYTIRDGFNLTNKGFNIENS
GQNIERNPALQKLSSESVVDLFTKVCVDGIITSKTKSIEGRYADAIFTASYRKVLGQLSARKLLQDILS
RALAGGGGSGGGGSGGGGSALALQCIKVKNNRLPYVADKDSISQEIFENKIITDETNVQNYSDKFS
LDESILDGQVPINPEIVDPLLPNVNMEPLNLPGEEIVFYDDITKYVDYLNSYYYLESQKLSNNVENITL
TTSVEEALGYSNKIYTFLPSLAEKVNKGVQAGLFLNWANEVVEDFTTNIMKKDTLDKISDVSVIIPYIG
PALNIGNSALRGNFNQAFATAGVAFLLEGFPEFTIPALGVFTFYSSIQEREKIIKTIENCLEQRVKRWK
DSYQWMVSNWLSRITTQFNHINYQMYDSLSYQADAIKAKIDLEYKKYSGSDKENIKSQVENLKNSL
DVKISEAMNNINKFIRECSVTYLFKNMLPKVIDELNKFDLRTKTELINLIDSHNIILVGEVDRLKAKVNE
SFENTMPFNIFSYTNNSLLKDIINEYFN
```

---

SEQUENCE LISTING (186 sequences)

SEQ ID NO: 1 - DNA, 2619 bp, Artificial Sequence
  source: /note="Description of Artificial Sequence: Synthetic polynucleotide"
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaaaacaaagcgctgaacctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccactctagaataatgaaagctt

SEQ ID NO: 2 - DNA, 2634 bp, Artificial Sequence
  source: /note="Description of Artificial Sequence: Synthetic polynucleotide"
ggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcgtcgacgaagaaaagctgtacgacgacgacgacaaagaccgttggggttcttcgctgcagtgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacgcaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaactctctagaataatgaaagctt

SEQ ID NO: 3 - DNA, 2620 bp, Artificial Sequence
  source: /note="Description of Artificial Sequence: Synthetic polynucleotide"
ggatccatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccaagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgattgatggtcgtagcctgtacaacaaaaccctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagactaataagctt

SEQ ID NO: 4 - DNA, 2638 bp, Artificial Sequence
  source: /note="Description of Artificial Sequence: Synthetic polynucleotide"
ggatccatgacgtggccagttaaggatttcaactactcagatcctgtaaatgacaacgatattctgtaccttcgcattccacaaaataaactgatcaccacaccagtcaaagcattcatgattactcaaaacatttgggtcattccagaacgcttttctagtgacacaaatccgagtttatctaaacctccgcgtccgacgtccaaatatcagagctattacgatccctcatatctcagtacggacgaacaaaaagatactttccttaaaggtatcattaaactgtttaagcgtattaatgagcgcgatatcgggaaaaagttgattaattatcttgttgtgggttccccgttcatgggcgatagctctacccccgaagacacttttgattttacccgtcatacgacaaacatcgcggtagagaagtttgagaacggatcgtggaaagtcacaaacatcattacacctagcgtcttaatttttggtccgctgccaaacatcttagattatacagccagcctgactttgcaggggcaacagtcgaatccgagtttcgaaggttttggtaccctgagcattctgaaagttgccccggaatttctgctcactttttcagatgtcaccagcaaccagagctcagcagtattaggaaagtcaattttttgcatggacccggttattgcactgatgcacgaactgacgcactctctgcatcaactgtatgggatcaacatccccagtgacaaacgtattcgtccccaggtgtctgaaggatttttctcacaggatgggccgaacgtccagttcgaagagttgtatactttcggaggcctggacgtagagatcattccccagattgagcgcagtcagctgcgtgagaaggcattgggccattataaggatattgcaaaacgcctgaataacattaacaaaacgattccatcttcgtggatctcgaatattgataaatataagaaaatttttagcgagaaatataattttgataaagataatacaggtaactttgtggttaacattgacaaattcaactccctttacagtgatttgacgaatgtaatgagcgaagttgtgtatagttcccaatacaacgttaagaatcgtacccattacttctctcgtcactacctgccggttttcgcgaacatccttgacgataatatttacactattcgtgacggctttaacttgaccaacaagggcttcaatattgaaaattcaggccagaacattgaacgcaacccggccttgcagaaactgtcgagtgaatccgtggttgacctgtttaccaaagtctgcgtcgacaaaagcgaagagaagctgtacgatgacgatgacaaagatcgttggggatcgtccctgcagtgtattaaagtgaaaaacaatcggctgccttatgtagcagataaagatagcattagtcaggagattttcgaaaataaaattatcactgacgaaaccaatgttcagaattattcagataaattttcactggacgaaagcatcttagatggccaagttccgattaacccggaaattgttgatccgttactgccgaacgtgaatatggaaccgttaaacctccctggcgaagagatcgtattttatgatgacattacgaaatatgtggactaccttaattcttattactatttggaaagccagaaactgtccaataacgtggaaaacattactctgaccacaagcgtggaagaggctttaggctactcaaataagatttataccttcctcccgtcgctggcggaaaaagtaaataaaggtgtgcaggctggtctgttcctcaactgggcgaatgaagttgtcgaagactttaccacgaatattatgaaaaaggataccctggataaaatctccgacgtctcggttattatcccatatattggccctgcgttaaatatcggtaatagtgcgctgcgggggaattttaaccaggcctttgctaccgcgggcgtcgcgttcctcctggagggctttcctgaatttactatcccggcgctcggtgtttttacattttactcttccatccaggagcgtgagaaaattatcaaaaccatcgaaaactgcctggagcagcgggtgaaacgctggaaagattcttatcaatggatggtgtcaaactggttatctcgcatcacgacccaattcaaccatattaattaccagatgtatgatagtctgtcgtaccaagctgacgccattaaagccaaaattgatctggaatataaaaagtactctggtagcgataaggagaacatcaaaagccaggtggagaaccttaagaatagtctggatgtgaaaatctctgaagctatgaataacattaacaaattcattcgtgaatgttcggtgacgtacctgttcaagaatatgctgccaaaagttattgatgaactgaataaatttgatctgcgtaccaaaaccgaacttatcaacctcatcgactcccacaacattatccttgtgggcgaagtggatcgtctgaaggccaaagtaaacgagagctttgaaaatacgatgccgtttaatattttttcatataccaataactccttgctgaaagatatcatcaatgaatatttcaatctagaataataagctt

SEQ ID NO: 5 - DNA, 2065 bp, Artificial Sequence
  source: /note="Description of Artificial Sequence: Synthetic polynucleotide"
ggatccatggagtccaatcagccggaaaaaaatggaaccgcgactaaacccgagaattcggggaacactacgtcggaaaacggccagacggaacctgagaagaaactggaactacgaaatgtgtccgatatcgagctatactctcaaaccaatggaacctataggcagcatgtttcattggacggaatcccagaaaatacggatacatatttcgtcaaagtgaagtctagcgcattcaaggatgtatatatccccgttgcgagtattacagaagagaagcggaacggtcaaagcgtttataagattacagcaaaggccgaaaagttacaacaggagttagaaaacaaatacgttgacaatttcactttttatctcgataaaaaggctaaagaggaaaacacgaacttcacgtcatttagtaatctggtcaaagccataaatcaaaatccatctggtacataccatctcgcggcaagtctaaacgcgaatgaagtagaacttggcccggacgagcgttcatacattaaggatacctttactggcagactcataggggaaaaagacggtaagaactatgctatatacaatttgaaaaagcctttatttgagaacctgtcgggcgccaccgtcgagaaattgtcccttaaaaacgtagctataagcggaaagaatgacatcggtagtcttgcaaacgaggctactaacgggacaaagattaaacaagtgcacgtagatgggtgtgtcgacggcatcattacctccaaaactaaatctgacgatgacgataaaaacaaagcgctgaacctgcagtgcattaaaataaagaatgaggatttgacattcatcgcagaaaaaaatagcttcagcgaagagccgttccaagatgagatagtaagctacaacaccaagaacaagccgcttaattttaattactcgttagataaaatcatagttgactacaaccttcaatcgaagatcacgttaccgaatgacagaacaactcctgtcacaaaaggaattccctatgcacctgagtataagtcaaatgccgcgtcaacaatagagattcataatatagatgacaacaccatctatcaatatctgtacgctcagaaaagtccaacaactcttcagcgtataacaatgaccaatagtgtcgatgacgcattgataaattctaccaagatatactcttatttcccgagcgtcatctccaaagttaatcaaggtgctcaaggcattctatttttgcaatgggtccgagacatcatagatgacttcactaatgagtcgtctcagaaaaccacgattgataaaatatcagatgtttccaccatcgtcccctacatcggacctgcgcttaacattgtgaagcaggggtatgaggggaattttatcggagcgttagaaactacgggggttgtgctattacttgaatacataccagagataacattgcccgttatagcggccctcagtatcgcagaatcaagtacacaaaaagaaaagataatcaaaacaatcgacaacttcctagaaaagaggtacgaaaaatggatagaggtttataaactcgtgaaagcgaaatggttaggcactgttaatacgcagttccaaaagagatcctatcaaatgtatagatcactggagtaccaggtggatgccataaagaaaattatcgactatgaatataaaatatattcaggtccagataaggagcagatagctgatgaaataaacaatttaaaaaacaaacttgaagagaaggcgaataaggccatgatcaatatcaatatttttatgcgagaatcttcacgatcttttttggtaaatcagatgattaacgaagccaaaaagcagctgcttgagttcgacacacagtccaaaaacatactaatgcaatatatcaaagcaaactcaaaattcattggaattactgagctgaagaaactggaatccaaaataaataaagtattctctaccccgatcccgttctcttactctaaaaaccttgactgctgggtagataacgaagaagatattgacgttctagagtaataagctt

SEQ ID NO: 6 - DNA, 219 bp, Artificial Sequence
  source: /note="Description of Artificial Sequence: Synthetic polynucleotide"
catatgccggttggatccatccaggtcgactttaaactgcagggtgttactctagagggcggtggcggtagcggtggcggtggcagcggcggtggcggtagcgcactagtgggcagctcatttctgtctccggaacatcaacgggtgcagcagcgtaaagagagtaaaaagccgccagcgaaattacagcctcgctaatagaagcttaagggcgaattc

SEQ ID NO: 7 - DNA, 2784 bp, Artificial Sequence
  source: /note="Description of Artificial Sequence: Synthetic polynucleotide"
catatgccggttggatccatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgattgatggtcgtagcctgtacaacaaaaccctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaatctagagggcggtggcggtagcggtggcggtggcagcggcggtggcggtagcgcactagtgggcagctcatttctgtctccggaacatcaacgggtgcagcagcgtaaagagagtaaaaagccgccagcgaaattacagcctcgctaatagaagcttaagggcgaattc

SEQ ID NO: 8 - protein, 913 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVGSSFLSPEHQRVQQRKESKKPPAKLQPR

SEQ ID NO: 9 - protein, 931 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVYADAIFTNSYRKVLGQLSARKLLQDIMSRQQGESNQERGA

SEQ ID NO: 10 - protein, 944 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVNSDSECPLSHDGYCLHDGVCMYIEALDKYACNCVVGYIGERCQYRDLKWWELR

SEQ ID NO: 11 - protein, 1134 aa, Artificial Sequence [sequence omitted]

SEQ ID NO: 12 - protein, 898 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVSCHLPWA

SEQ ID NO: 13 - protein, 919 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVHSDAVFTDNYTRLRKQMAVKKYLNSILN

SEQ ID NO: 14 - protein, 892 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVSCHLPWA

SEQ ID NO: 15 - protein, 955 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVGPETLCGAELVDALQFVCGDRGFYFNKPTGYGSSSRRAPQTGIVDECCFRSCDLRRLEMYCAPLKPAKSA

SEQ ID NO: 16 - protein, 919 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSGGGGSGGGGSGGGGSGGGGSALVAGCKNFFWKTFTSC

SEQ ID NO: 17 - protein, 919 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVGSSFLSPEHQRVQQRKESKKPPAKLQPR

SEQ ID NO: 18 - protein, 961 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVGPETLCGAELVDALQFVCGDRGFYFNKPTGYGSSSRRAPQTGIVDECCFRSCDLRRLEMYCAPLKPAKSA

SEQ ID NO: 19 - protein, 1108 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 20 - protein, 910 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSALVAGCKNFFWKTFTSC

SEQ ID NO: 21 - protein, 913 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVHSDAVFTDNYTRLRKQMAVKKYLNSILN

SEQ ID NO: 22 - protein, 912 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVGSSFLSPEHQRVQQRKESKKPPAKLQPR

SEQ ID NO: 23 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSIEGRYADAIFTASYRNVLGQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 24 - protein, 910 aa, Artificial Sequence
  source: /note="Description of Artificial Sequence: Synthetic polypeptide"
HVDAIFTQSYRKVLAQLSARKLLQDILNRNNNNNNNNNNTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 25 - protein, 714 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKNKALNLQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVLEGGGGSGGGGSGGGGSALVAGCKNFFWKTFTSC

SEQ ID NO: 26 - protein, 728 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKNKALNLQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVLEGGGGSGGGGSGGGGSALVGSSFLSPEHQRVQQRKESKKPPAKLQPR

SEQ ID NO: 27 - protein, 899 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEIYALVGSWFLSPEHQRVQQRKESKKPPAKLQPR

SEQ ID NO: 28 - protein, 929 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSGGGGSALVSANSNPAMAPRERKAGCKNFFWKTFTSC

SEQ ID NO: 29 - protein, 901 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVGNHWAVGHLM

SEQ ID NO: 30 - protein, 899 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDEEKLYDDDDKDRWGSSLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDAIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEGGGGSGGGGSGGGGSALVGNHWAVGHLM

SEQ ID NO: 31 - DNA, 205 bp, Artificial Sequence
  source: /note="Description of Artificial Sequence: Synthetic polynucleotide"
ggatccgtcgacaacaacaataacaacaacaataacaacaacgacgatgacgataaacatgtggatgcgatctttacccagagctatcggaaggttttggcccaactgtctgctcgtaaacttttacaggacattctgaacagagcagaagcggcagccaaagaagcagccgctaaggcgctgcagagtctagaataataagctt

SEQ ID NO: 32 - DNA, 2754 bp, Artificial Sequence
  source: /note="Description of Artificial Sequence: Synthetic polynucleotide"
ggatccatgacgtggccagttaaggatttcaactactcagatcctgtaaatgacaacgatattctgtaccttcgcattccacaaaataaactgatcaccacaccagtcaaagcattcatgattactcaaaacatttgggtcattccagaacgcttttctagtgacacaaatccgagtttatctaaacctccgcgtccgacgtccaaatatcagagctattacgatccctcatatctcagtacggacgaacaaaaagatactttccttaaaggtatcattaaactgtttaagcgtattaatgagcgcgatatcgggaaaaagttgattaattatcttgttgtgggttccccgttcatgggcgatagctctacccccgaagacacttttgattttacccgtcatacgacaaacatcgcggtagagaagtttgagaacggatcgtggaaagtcacaaacatcattacacctagcgtcttaatttttggtccgctgccaaacatcttagattatacagccagcctgactttgcaggggcaacagtcgaatccgagtttcgaaggttttggtaccctgagcattctgaaagttgccccggaatttctgctcactttttcagatgtcaccagcaaccagagctcagcagtattaggaaagtcaattttttgcatggacccggttattgcactgatgcacgaactgacgcactctctgcatcaactgtatgggatcaacatccccagtgacaaacgtattcgtccccaggtgtctgaaggatttttctcacaggatgggccgaacgtccagttcgaagagttgtatactttcggaggcctggacgtagagatcattccccagattgagcgcagtcagctgcgtgagaaggcattgggccattataaggatattgcaaaacgcctgaataacattaacaaaacgattccatcttcgtggatctcgaatattgataaatataagaaaatttttagcgagaaatataattttgataaagataatacaggtaactttgtggttaacattgacaaattcaactccctttacagtgatttgacgaatgtaatgagcgaagttgtgtatagttcccaatacaacgttaagaatcgtacccattacttctctcgtcactacctgccggttttcgcgaacatccttgacgataatatttacactattcgtgacggctttaacttgaccaacaagggcttcaatattgaaaattcaggccagaacattgaacgcaacccggccttgcagaaactgtcgagtgaatccgtggttgacctgtttaccaaagtctgcgtcgacaacaacaataacaacaacaataacaacaacgacgatgacgataaacatgtggatgcgatctttacccagagctatcggaaggttttggcccaactgtctgctcgtaaacttttacaggacattctgaacagagcagaagcggcagccaaagaagcagccgctaaggcgctgcagtgtattaaagtgaaaaacaatcggctgccttatgtagcagataaagatagcattagtcaggagattttcgaaaataaaattatcactgacgaaaccaatgttcagaattattcagataaattttcactggacgaaagcatcttagatggccaagttccgattaacccggaaattgttgatccgttactgccgaacgtgaatatggaaccgttaaacctccctggcgaagagatcgtattttatgatgacattacgaaatatgtggactaccttaattcttattactatttggaaagccagaaactgtccaataacgtggaaaacattactctgaccacaagcgtggaagaggctttaggctactcaaataagatttataccttcctcccgtcgctggcggaaaaagtaaataaaggtgtgcaggctggtctgttcctcaactgggcgaatgaagttgtcgaagactttaccacgaatattatgaaaaaggataccctggataaaatctccgacgtctcggttattatcccatatattggccctgcgttaaatatcggtaatagtgcgctgcgggggaattttaaccaggcctttgctaccgcgggcgtcgcgttcctcctggagggctttcctgaatttactatcccggcgctcggtgtttttacattttactcttccatccaggagcgtgagaaaattatcaaaaccatcgaaaactgcctggagcagcgggtgaaacgctggaaagattcttatcaatggatggtgtcaaactggttatctcgcatcacgacccaattcaaccatattaattaccagatgtatgatagtctgtcgtaccaagctgacgccattaaagccaaaattgatctggaatataaaaagtactctggtagcgataaggagaacatcaaaagccaggtggagaaccttaagaatagtctggatgtgaaaatctctgaagctatgaataacattaacaaattcattcgtgaatgttcggtgacgtacctgttcaagaatatgctgccaaaagttattgatgaactgaataaatttgatctgcgtaccaaaaccgaacttatcaacctcatcgactcccacaacattatccttgtgggcgaagtggatcgtctgaaggccaaagtaaacgagagctttgaaaatacgatgccgtttaatattttttcatataccaataactccttgctgaaagatatcatcaatgaatatttcaatctagaataatgaaagctt

SEQ ID NO: 33 - protein, 909 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDNNNNNNNNNNDDDDKHVDAIFTQSYRKVLAQLSARKLLQDILNRAEAAAKEAAAKALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 34 - protein, 919 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRHVDAIFTQSYRKVLAQLSARKLLQDILNRQQGERNQEQGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 35 - protein, 919 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRHVDAIFTQSYRKVLAQLSARKLLQDILNRQQGERNQEQGALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 36 - protein, 928 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTQSYRKVLAQLSARKLLQDILNRQQGERNQEQGAALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 37 - protein, 913 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDNNNNNNNNNNDDDDKHVDAIFTQSYRKVLAQLSARKLLQDILNRQQGERNQEQGAPAPAPLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 38 - protein, 919 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDNNNNNNNNNNDDDDKHVDAIFTQSYRKVLAQLSARKLLQDILNRQQGERNQEQGAEAAAKEAAAKALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 39 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKSANSNPAMAPRERKAGCKNFFWKTFTSCALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 40 - protein, 902 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKAGCKNFFWKTFTSCALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 41 - protein, 710 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKAGCKNFFWKTFTSCALAGGGGSGGGGSGGGGSALALQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDV

SEQ ID NO: 42 - protein, 918 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGGGGSADDDDKNDDPPISIDLTFHLLRNMIEMARIENEREQAGLNRKYLDEVALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 43 - protein, 926 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGGGGSGGGGSADDDDKVVSHFNDCPDSHTQFCFHGTCRFLVQEDKPACVCHSGYVGARCEHADLLAALAKRLVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDAIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 44 - protein, 940 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGGGGSGGGGSADDDDKVVSHFNDCPDSHTQFCFHGTCRFLVQEDKPACVCHSGYVGARCEHADLLAALAGGGGSGGGGSGGGGSALVLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDAIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 45 - protein, 864 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 46 - protein, 869 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDEEKLYDDDDKDRWGSSLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDAIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 47 - protein, 865 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 48 - protein, 871 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 49 - protein, 680 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKNKALNLQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDV

SEQ ID NO: 50 - protein, 9 aa, Artificial Sequence
  source: /note="Description of Artificial Sequence: Synthetic peptide"
  MOD_RES (2)..(2): D-Phe
  MOD_RES (5)..(5): D-Trp
  misc_feature (9)..(9): /note="C-terminal-alcohol"
CFCFWKTCT

SEQ ID NO: 51 - protein, 30 aa, Artificial Sequence
  source: /note="Description of Artificial Sequence: Synthetic polypeptide"
  MOD_RES (27)..(27): Norleucine
HADAIFTNSYRKVLGQLSARKLLQDILSRC

SEQ ID NO: 52 - protein, 30 aa, Artificial Sequence
  source: /note="Description of Artificial Sequence: Synthetic polypeptide"
  MOD_RES (1)..(1): PhAc-Tyr
  MOD_RES (2)..(2): D-Arg
  MOD_RES (6)..(6): Phe(4-Cl)
  MOD_RES (9)..(9): Homoarginine
  MOD_RES (10)..(10): Tyr(Me)
  MOD_RES (15)..(15): Alpha-aminobutyric acid
  MOD_RES (27)..(27): Norleucine
  MOD_RES (28)..(28): D-Arg
  MOD_RES (29)..(29): Homoarginine
YRDAIFTARYHKVLXQLSAHKLLQDILRRC

SEQ ID NO: 53 - protein, 893 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKDFDMLRCMLGRVYRPCWQVALAKRLVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 54 - protein, 902 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVYNWNSFGLRFG

SEQ ID NO: 55 - protein, 905 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVTPDINPAWYASRGIRPVGRFG

SEQ ID NO: 56 - protein, 927 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGGGGSADDDDKSEEPPISLDLTFHLLREVLEMARAEQLAQQAHSNRKLMEIIALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 57 - protein, 915 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 58 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 59 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 60 - protein, 932 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSRQQGESNQERGARARLALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 61 - protein, 927 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSRQQGESNQERGALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 62 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNAYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 63 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKALQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 64 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYKKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 65 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYKRVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 66 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYNKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 67 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSAKKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 68 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYKKVLGQLSAKKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 69 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSANKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 70 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRNVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 71 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSARNLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 72 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFEASYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 73 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASERKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 74 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKELGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 75 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 76 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTESYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 77 - protein, 915 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLAQLSARKLLQDIMALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 78 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLAQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 79 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLAQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 80 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTAAYRKVLAQLSARKALQDIASRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 81 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTAAYRKVLAQLSARKALQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 82 - protein, 920 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTQSYRKVLAQLSARKALQDILSRQQGALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 83 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTSSYRKVLAQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 84 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTTSYRKVLAQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 85 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTQSYRKVLAQLSARKALQDILNRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 86 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTQSYRKVLAQLSARKALQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 87 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSIEGRYADAIFTASYRKVLGQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 88 - protein, 44 aa, Artificial Sequence
  GHRH Peptide Analogue
YADAIFTNSYRKVLGQLSARKLLQDIMSRQQGESNQERGARARL

SEQ ID NO: 89 - protein, 29 aa, Artificial Sequence
  GHRH Peptide Analogue
YADAIFTNSYRKVLGQLSARKLLQDIMSR

SEQ ID NO: 90 - protein, 29 aa, Artificial Sequence
  GHRH Peptide Analogue
YADAIFTNSYRKVLGQLSARKLLQDIMSR

SEQ ID NO: 91 - protein, 44 aa, Artificial Sequence
  GHRH Peptide Analogue
YADAIFTNSYRKILGQLSARKLLQDIMNRQQGERNQEQGAKVRL

SEQ ID NO: 92 - protein, 44 aa, Artificial Sequence
  GHRH Peptide Analogue
YADAIFTNSYRKVLGQLSARKLLQDIMNRQQGERNQEQGAKVRL

SEQ ID NO: 93 - protein, 29 aa, Artificial Sequence
  GHRH Peptide Analogue
HVDAIFTQSYRKVLAQLSARKLLQDILNR

SEQ ID NO: 94 - protein, 40 aa, Artificial Sequence
  GHRH Peptide Analogue
HVDAIFTQSYRKVLAQLSARKLLQDILNRQQGERNQEQGA

SEQ ID NO: 95 - protein, 14 aa, Artificial Sequence
  Bombesin
EQRLGNQWAVGHLM

SEQ ID NO: 96 - protein, 27 aa, Artificial Sequence
  Porcine GRP
APVSVGGGTVLAKMYPRGNHWAVGHLM

SEQ ID NO: 97 - protein, 27 aa, Artificial Sequence
  Human GRP
VPLPAGGGTVLTKMYPRGNHWAVGHLM

SEQ ID NO: 98 - protein, 6 aa, Artificial Sequence
  Urotensin Peptide Analogue
  MISC_FEATURE (2)..(2): Xaa is Ple
CXWKYC

SEQ ID NO: 99 - protein, 4 aa, Artificial Sequence
  Central region of Somatostatin
FWKT

SEQ ID NO: 100 - protein, 5 aa, Artificial Sequence
  Enterokinase protease cleavage sequence
DDDDK

SEQ ID NO: 101 - protein, 4 aa, Artificial Sequence
  Factor Xa protease cleavage sequence
IEGR

SEQ ID NO: 102 - protein, 4 aa, Artificial Sequence
  Factor Xa protease cleavage sequence
IDGR

SEQ ID NO: 103 - protein, 7 aa, Artificial Sequence
  TEV protease cleavage sequence
ENLYFQG

SEQ ID NO: 104 - protein, 6 aa, Artificial Sequence
  Thrombin protease cleavage sequence
LVPRGS

SEQ ID NO: 105 - protein, 8 aa, Artificial Sequence
  PreScission protease cleavage sequence
LEVLFQGP

SEQ ID NO: 106 - protein, 4 aa, Artificial Sequence
  Caspase 3 destructive cleavage site recognition sequence
DMQD

SEQ ID NO: 107 - protein, 10 aa, Artificial Sequence
  ADAM17 destructive cleavage site recognition sequence
PLAQAVRSSS

SEQ ID NO: 108 - protein, 10 aa, Artificial Sequence
  HAT destructive cleavage site recognition sequence
SKGRSLIGRV

SEQ ID NO: 109 - protein, 6 aa, Artificial Sequence
  Elastase (leukocyte) destructive cleavage site recognition sequence
MEAVTY

SEQ ID NO: 110 - protein, 4 aa, Artificial Sequence
  Furin destructive cleavage site recognition sequence
  MISC_FEATURE (2)..(2): Xaa is any amino acid residue
  MISC_FEATURE (3)..(3): Xaa is Arg or Lys
RXXR

SEQ ID NO: 111 - protein, 4 aa, Artificial Sequence
  Granzyme destructive cleavage site recognition sequence
IEPD

SEQ ID NO: 112 - protein, 4 aa, Artificial Sequence
  Caspase 2 destructive cleavage site recognition sequence
DVAD

SEQ ID NO: 113 - protein, 4 aa, Artificial Sequence
  Caspase 4 destructive cleavage site recognition sequence
LEVD

SEQ ID NO: 114 - protein, 4 aa, Artificial Sequence
  Caspase 7 destructive cleavage site recognition sequence
DEVD

SEQ ID NO: 115 - protein, 4 aa, Artificial Sequence
  Caspase 9 destructive cleavage site recognition sequence
LEHD

SEQ ID NO: 116 - protein, 4 aa, Artificial Sequence
  Caspase 10 destructive cleavage site recognition sequence
IEHD

SEQ ID NO: 117 - protein, 23 aa, Artificial Sequence
  Influenza virus haemagglutinin
GLFGAIAGFIENGWEGMIDGWYG

SEQ ID NO: 118 - protein, 9 aa, Artificial Sequence
  Fragment of TGF-alpha
  ACETYLATION (1)..(1): N-terminal acetylation
  METHYLATION (3)..(3): C-terminal methylation
CHSGYVGAR

SEQ ID NO: 119 - protein, 12 aa, Artificial Sequence
  Modified ErbB targeting moiety
YHWYGYTPQNVI

SEQ ID NO: 120 - protein, 116 aa, Artificial Sequence
  Somatostatin
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 121 - protein, 155 aa, Artificial Sequence
  Cortistatin
MYRHKNSWRLGLKYPPSSKEETQVPKTLISGLPGRKSSSRVGEKLQSAHKMPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 122 - protein, 7 aa, Artificial Sequence
  Targeting moiety for somatostatin receptor
NFFWKTF

SEQ ID NO: 123 - protein, 8 aa, Artificial Sequence
  Targeting moiety for somatostatin receptor
  MISC_FEATURE (1)..(1): Xaa is Arg or Lys
XNFFWKTF

SEQ ID NO: 124 - protein, 9 aa, Artificial Sequence
  Targeting moiety for somatostatin receptor
  MISC_FEATURE (2)..(2): Xaa is Arg or Lys
CXNFFWKTF

SEQ ID NO: 125 - protein, 10 aa, Artificial Sequence
  Targeting moiety for somatostatin receptor
  MISC_FEATURE (1)..(1): Xaa is Pro or Gly
  MISC_FEATURE (3)..(3): Xaa is Arg or Lys
XCXNFFWKTF

SEQ ID NO: 126 - protein, 8 aa, Artificial Sequence
  Targeting moiety for somatostatin receptor
  MISC_FEATURE (8)..(8): Xaa is Ser or Thr
NFFWKTFX

SEQ ID NO: 127 - protein, 9 aa, Artificial Sequence
  Targeting moiety for somatostatin receptor
  MISC_FEATURE (8)..(8): Xaa is Ser or Thr
NFFWKTFXS

SEQ ID NO: 128 - protein, 10 aa, Artificial Sequence
  Targeting moiety for somatostatin receptor
  MISC_FEATURE (8)..(8): Xaa is Ser or Thr
NFFWKTFXSC

SEQ ID NO: 129 - protein, 9 aa, Artificial Sequence
  Targeting moiety for somatostatin receptor
  MISC_FEATURE (1)..(1): Xaa is Arg or Lys
  MISC_FEATURE (9)..(9): Xaa is Ser or Thr
XNFFWKTFX

SEQ ID NO: 130 - protein, 10 aa, Artificial Sequence
  Targeting moiety for somatostatin receptor
  MISC_FEATURE (1)..(1): Xaa is Arg or Lys
  MISC_FEATURE (9)..(9): Xaa is Ser or Thr
XNFFWKTFXS

SEQ ID NO: 131 - protein, 11 aa, Artificial Sequence
  Targeting moiety for somatostatin receptor
  MISC_FEATURE (1)..(1): Xaa is Arg or Lys
  MISC_FEATURE (9)..(9): Xaa is Ser or Thr
XNFFWKTFXSC

SEQ ID NO: 132 - protein, 10 aa, Artificial Sequence
  Targeting moiety for somatostatin receptor
  MISC_FEATURE (2)..(2): Xaa is Arg or Lys
  MISC_FEATURE (10)..(10): Xaa is Ser or Thr
CXNFFWKTFX

SEQ ID NO: 133 - protein, 11 aa, Artificial Sequence
  Targeting moiety for somatostatin receptor
  MISC_FEATURE (2)..(2): Xaa is Arg or Lys
  MISC_FEATURE (10)..(10): Xaa is Ser or Thr
CXNFFWKTFXS

SEQ ID NO: 134 - protein, 12 aa, Artificial Sequence
  Targeting moiety for somatostatin receptor
  MISC_FEATURE (2)..(2): Xaa is Arg or Lys
  MISC_FEATURE (10)..(10): Xaa is Ser or Thr
CXNFFWKTFXSC

SEQ ID NO: 135 - protein, 11 aa, Artificial Sequence
  Targeting moiety for somatostatin receptor
  MISC_FEATURE (1)..(1): Xaa is Pro or Gly
  MISC_FEATURE (3)..(3): Xaa is Arg or Lys
  MISC_FEATURE (11)..(11): Xaa is Ser or Thr
XCXNFFWKTFX

SEQ ID NO: 136 - protein, 12 aa, Artificial Sequence
  Targeting moiety for somatostatin receptor
  MISC_FEATURE (1)..(1): Xaa is Pro or Gly
  MISC_FEATURE (3)..(3): Xaa is Arg or Lys
  MISC_FEATURE (11)..(11): Xaa is Ser or Thr
XCXNFFWKTFXS

SEQ ID NO: 137 - protein, 13 aa, Artificial Sequence
  Targeting moiety for somatostatin receptor
  MISC_FEATURE (1)..(1): Xaa is Pro or Gly
  MISC_FEATURE (3)..(3): Xaa is Arg or Lys
  MISC_FEATURE (11)..(11): Xaa is Ser or Thr
XCXNFFWKTFXSC

SEQ ID NO: 138 - protein, 28 aa, Artificial Sequence
  Somatostatin Targeting Moiety
SANSNPAMAPRERKAGCKNFFWKTFTSC

SEQ ID NO: 139 - protein, 14 aa, Artificial Sequence
  Somatostatin Targeting Moiety
AGCKNFFWKTFTSC

SEQ ID NO: 140 - protein, 29 aa, Artificial Sequence
  Cortistatin Targeting Moiety
QEGAPPQQSARRDRMPCRNFFWKTFSSCK

SEQ ID NO: 141 - protein, 29 aa, Artificial Sequence
  Cortistatin Targeting Moiety
QERPPLQQPPHRDKKPCKNFFWKTFSSCK

SEQ ID NO: 142 - protein, 29 aa, Artificial Sequence
  Cortistatin Targeting Moiety
QERPPPQQPPHLDKKPCKNFFWKTFSSCK

SEQ ID NO: 143 - protein, 17 aa, Artificial Sequence
  Cortistatin Targeting Moiety
DRMPCRNFFWKTFSSCK

SEQ ID NO: 144 - protein, 14 aa, Artificial Sequence
  Cortistatin Targeting Moiety
PCRNFFWKTFSSCK

SEQ ID NO: 145 - protein, 14 aa, Artificial Sequence
  Cortistatin Targeting Moiety
PCKNFFWKTFSSCK

SEQ ID NO: 146 - protein, 29 aa, Artificial Sequence
  Targeting Moiety for GH-Secreting Cell
YADAIFTASYRKVLGQLSARKLLQDILSR

SEQ ID NO: 147 - protein, 29 aa, Artificial Sequence
  Targeting Moiety for GH-Secreting Cell
YADAIFTASYRNVLGQLSARKLLQDILSR

SEQ ID NO: 148 - protein, 27 aa, Artificial Sequence
  Targeting Moiety for GH-Secreting Cell
YADAIFTNSYRKVLGQLSARKLLQDIM

SEQ ID NO: 149 - protein, 28 aa, Artificial Sequence
  Targeting Moiety for GH-Secreting Cell
YADAIFTNSYRKVLGQLSARKLLQDIMS

SEQ ID NO: 150 - protein, 28 aa, Artificial Sequence
  Targeting Moiety for GH-Secreting Cell
ADAIFTNSYRKVLGQLSARKLLQDIMSR

SEQ ID NO: 151 - protein, 44 aa, Artificial Sequence; identical to SEQ ID NO: 88
  Targeting Moiety for GH-Secreting Cell

SEQ ID NO: 152 - protein, 40 aa, Artificial Sequence
  Targeting Moiety for GH-Secreting Cell
YADAIFTNSYRKVLGQLSARKLLQDIMSRQQGESNQERGA

SEQ ID NO: 153 - protein, 29 aa, Artificial Sequence
  Targeting Moiety for GH-Secreting Cell
YADAIFTNAYRKVLGQLSARKLLQDIMSR

SEQ ID NO: 154 - protein, 29 aa, Artificial Sequence
  Targeting Moiety for GH-Secreting Cell
YADAIFTNSYRKVLGQLSARKALQDIMSR

SEQ ID NO: 155 - protein, 29 aa, Artificial Sequence
  Targeting Moiety for GH-Secreting Cell
YADAIFTASYKKVLGQLSARKLLQDIMSR

SEQ ID NO: 156 - protein, 29 aa, Artificial Sequence
  Targeting Moiety for GH-Secreting Cell
YADAIFTASYKRVLGQLSARKLLQDIMSR

SEQ ID NO: 157 - protein, 29 aa, Artificial Sequence
  Targeting Moiety for GH-Secreting Cell
YADAIFTASYNKVLGQLSARKLLQDIMSR

SEQ ID NO: 158 - protein, 29 aa, Artificial Sequence
  Targeting Moiety for GH-Secreting Cell
YADAIFTASYRKVLGQLSAKKLLQDIMSR

SEQ ID NO: 159 - protein, 29 aa, Artificial Sequence
  Targeting Moiety for GH-Secreting Cell
YADAIFTASYKKVLGQLSAKKLLQDIMSR

SEQ ID NO: 160 - protein, 29 aa, Artificial Sequence
  Targeting Moiety for GH-Secreting Cell
YADAIFTASYRKVLGQLSANKLLQDIMSR

SEQ ID NO: 161 - protein, 29 aa, Artificial Sequence
  Targeting Moiety for GH-Secreting Cell
YADAIFTASYRNVLGQLSARKLLQDIMSR

SEQ ID NO: 162 - protein, 29 aa, Artificial Sequence
  Targeting Moiety for GH-Secreting Cell
YADAIFTASYRKVLGQLSARNLLQDIMSR

SEQ ID NO: 163 - protein, 29 aa, Artificial Sequence
  Targeting Moiety for GH-Secreting Cell
YADAIFEASYRKVLGQLSARKLLQDIMSR

SEQ ID NO: 164 - protein, 29 aa, Artificial Sequence
  Targeting Moiety for GH-Secreting Cell
YADAIFTASERKVLGQLSARKLLQDIMSR

SEQ ID NO: 165 - protein, 29 aa, Artificial Sequence
  Targeting Moiety for GH-Secreting Cell
YADAIFTASYRKELGQLSARKLLQDIMSR

SEQ ID NO: 166 - protein, 29 aa, Artificial Sequence
  Targeting Moiety for GH-Secreting Cell
YADAIFTASYRKVLGQLSARKLLQDIMSR

SEQ ID NO: 167 - protein, 29 aa, Artificial Sequence
  Targeting Moiety for GH-Secreting Cell
YADAIFTESYRKVLGQLSARKLLQDIMSR

SEQ ID NO: 168 - protein, 27 aa, Artificial Sequence
  Targeting Moiety for GH-Secreting Cell
YADAIFTNSYRKVLAQLSARKLLQDIM

SEQ ID NO: 169 - protein, 29 aa, Artificial Sequence
  Targeting Moiety for GH-Secreting Cell
YADAIFTNSYRKVLAQLSARKLLQDIMSR

SEQ ID NO: 170 - protein, 29 aa, Artificial Sequence
  Targeting Moiety for GH-Secreting Cell
YADAIFTASYRKVLAQLSARKLLQDIMSR

SEQ ID NO: 171 - protein, 29 aa, Artificial Sequence
  Targeting Moiety for GH-Secreting Cell
YADAIFTAAYRKVLAQLSARKALQDIASR

SEQ ID NO: 172 - protein, 29 aa, Artificial Sequence
  Targeting Moiety for GH-Secreting Cell
YADAIFTAAYRKVLAQLSARKALQDIMSR

SEQ ID NO: 173 - protein, 40 aa, Artificial Sequence; identical to SEQ ID NO: 94
  Targeting Moiety for GH-Secreting Cell

SEQ ID NO: 174 - protein, 32 aa, Artificial Sequence
  Targeting Moiety for GH-Secreting Cell
HVDAIFTQSYRKVLAQLSARKALQDILSRQQG

SEQ ID NO: 175 - protein, 29 aa, Artificial Sequence
  Targeting Moiety for GH-Secreting Cell
HVDAIFTSSYRKVLAQLSARKLLQDILSR

SEQ ID NO: 176 - protein, 29 aa, Artificial Sequence
  Targeting Moiety for GH-Secreting Cell
HVDAIFTTSYRKVLAQLSARKLLQDILSR

SEQ ID NO: 177 - protein, 29 aa, Artificial Sequence
  Targeting Moiety for GH-Secreting Cell
YADAIFTQSYRKVLAQLSARKALQDILNR

SEQ ID NO: 178 - protein, 29 aa, Artificial Sequence
  Targeting Moiety for GH-Secreting Cell
YADAIFTQSYRKVLAQLSARKALQDILSR

SEQ ID NO: 179 - protein, 15 aa, Artificial Sequence
  Serothype C Linker
HKAIDGRSLYNKTLD

SEQ ID NO: 180 - protein, 15 aa, Artificial Sequence
  Native Recognition Sequence for Factor Xa
VDAIDGRSLYNKTLQ

SEQ ID NO: 181 - protein, 23 aa, Artificial Sequence
  Enterokinase Activation Site
VDGIITSKTKSDDDDKNKALNLQ

SEQ ID NO: 182 - protein, 10 aa, Artificial Sequence
  Bombesin Analogue
GNQWAVGHLM

SEQ ID NO: 183 - protein, 10 aa, Artificial Sequence
  Bombesin Analogue
GNLWATGHFM

SEQ ID NO: 184 - protein, 10 aa, Artificial Sequence
  Bombesin Analogue
GNHWAVGHLM

SEQ ID NO: 185 - protein, 9 aa, Artificial Sequence
  Bombesin Analogue
EQWAVGHFM

SEQ ID NO: 186 - protein, 10 aa, Artificial Sequence
  Bombesin Analogue
GNHWAVGHLM

---

What is claimed is:

1. A method of treating cancer, the method comprising administering to a patient in need thereof an effective amount of a polypeptide comprising an amino acid sequence comprising:

a) a non-cytotoxic protease comprising a clostridial neurotoxin endopeptidase capable of cleaving a protein of the exocytic fusion apparatus in a pituitary cell;

b) a targeting moiety that is capable of binding to a growth hormone-releasing hormone (GHRH) receptor on the pituitary cell; and c) a translocation domain comprising a clostridial neurotoxin translocation domain capable of translocating the protease from within the endosome of the pituitary cell, across the endosomal membrane, and into the cytosol;

wherein:

the pituitary cell is a normal, non-diseased, noncancerous cell;

the method reduces secretion of growth hormone from the cell;

the cancer is prostate cancer; and the amino acid sequence is effective at treating prostate cancer.

2. The method of claim 1, wherein the targeting moiety is a growth hormone-releasing hormone (GHRH), truncation, or peptide analogue thereof.

3. The method of claim 1, wherein the amino acid sequence has at least 90% sequence identity to any one of SEQ ID NO: 36, 37, or 38.

4. The method of claim 1, wherein the amino acid sequence has at least 95% sequence identity to any one of SEQ ID NO: 36, 37, or 38.

5. The method of claim 1, wherein the amino acid sequence has at least 98% sequence identity to any one of SEQ ID NO: 36, 37, or 38.

6. The method of claim 1, wherein the amino acid sequence has at least 95% sequence identity to SEQ ID NO: 36.

7. The method of claim 1, wherein the targeting moiety comprises SEQ ID NO: 94.

8. The method of claim 1, wherein the amino acid sequence is any one of SEQ ID NO: 36, 37, or 38.

9. The method of claim 1, wherein the targeting moiety has the amino acid sequence of any one of SEQ ID NOs: 88, 91, 92, or 94.

10. The method of claim 1, wherein the targeting moiety has at least 90% sequence identity to any one of SEQ ID NOs: 88, 91, 92, or 94.

11. The method of claim 1, wherein the targeting moiety has at least 95% sequence identity to any one of SEQ ID NOs: 88, 91, 92, or 94.

12. The method of claim 1, wherein the targeting moiety has at least 90% sequence identity to any one of SEQ ID NOs: 91, 92, or 94.

13. The method of claim 1, wherein the targeting moiety has at least 95% sequence identity to any one of SEQ ID NOs: 91, 92, or 94.

14. The method of claim 1, wherein the targeting moiety has the amino acid sequence of any one of SEQ ID NOs: 91, 92, or 94.

* * * * *